US008865968B2

(12) United States Patent
Van De Craen et al.

(10) Patent No.: US 8,865,968 B2
(45) Date of Patent: Oct. 21, 2014

(54) METHOD FOR DOWN-REGULATING GENE EXPRESSION IN FUNGI

(75) Inventors: Marc Van De Craen, Aalter (BE); Phuay-Yee Goh, Singapore (SG); Marc Georges Logghe, St Denijs Westrem (BE); Yee-Ling Khu, Singapore (SG); Katherine An Hilde Mortier, Ghent (BE); Thierry Andre Oliver Eddy Bogaert, Kortrijk (BE)

(73) Assignee: Devgen NV, Zwijnaarde (BE)

( * ) Notice: Subject to any disclaimer, the term of this patent is extended or adjusted under 35 U.S.C. 154(b) by 468 days.

(21) Appl. No.: 12/778,278

(22) Filed: May 12, 2010

(65) Prior Publication Data

US 2010/0311819 A1 Dec. 9, 2010

Related U.S. Application Data

(60) Division of application No. 11/396,926, filed on Apr. 3, 2006, now abandoned, which is a continuation-in-part of application No. PCT/IB2005/003495, filed on Oct. 4, 2005.

(60) Provisional application No. 60/615,695, filed on Oct. 4, 2004.

(51) Int. Cl.

| | |
|---|---|
| ***C12N 15/82*** | (2006.01) |
| ***C12N 15/87*** | (2006.01) |
| ***C07H 21/04*** | (2006.01) |
| ***C07K 14/37*** | (2006.01) |
| ***A01N 63/02*** | (2006.01) |
| ***A01N 63/04*** | (2006.01) |

(52) U.S. Cl.

CPC ............ *C12N 15/8218* (2013.01); *C07K 14/37* (2013.01); *A01N 63/02* (2013.01); *A01N 63/04* (2013.01); *C12N 15/8282* (2013.01)

USPC ........... 800/286; 800/279; 800/285; 536/24.5

(58) Field of Classification Search

USPC .......................................................... 800/286

See application file for complete search history.

(56) References Cited

U.S. PATENT DOCUMENTS

| | | | |
|---|---|---|---|
| 6,506,559 | B1 | 1/2003 | Fire et al. |
| 2003/0180945 | A1 | 9/2003 | Wang et al. |
| 2004/0053289 | A1 | 3/2004 | Christian et al. |
| 2005/0034192 | A1 | 2/2005 | Damaj et al. |
| 2006/0247197 | A1 | 11/2006 | Van De Craen |

FOREIGN PATENT DOCUMENTS

| | | | |
|---|---|---|---|
| WO | WO 98/31812 | A1 | 7/1998 |
| WO | WO 99/32619 | A1 | 7/1999 |
| WO | WO 99/53050 | A1 | 10/1999 |
| WO | WO 00/01846 | A2 | 1/2000 |
| WO | WO 01/37654 | A2 | 5/2001 |
| WO | WO 01/96584 | A2 | 12/2001 |
| WO | WO 03/052110 | A2 | 6/2003 |
| WO | WO 2005/056722 | A2 | 6/2005 |
| WO | WO 2005/071091 | A1 | 8/2005 |

OTHER PUBLICATIONS

Devos et al. 2000, Protein 41:98-107.*

Rost 2002, JMB 318:595-608.*

Altschul et al., Basic local alignment search tool. J Mol Biol. Oct. 5, 1990;215(3):403-10.

Altschul et al., Gapped BLAST and PSI-BLAST: a new generation of protein database search programs. Nucleic Acids Res. Sep. 1, 1997;25(17):3389-402.

Baulcombe, RNA silencing in plants. Nature. Sep. 16, 2004;431(7006):356-63.

Borda et al., Zinc-dependent cleavage in the catalytic core of the hammerhead ribozyme: evidence for a pH-dependent conformational change.Nucleic Acids Res. May 15, 2003;31(10):2595-600.

Cogoni et al., Gene silencing in Neurospora crassa requires a protein homologous to RNA-dependent RNA polymerase. Nature. May 13, 1999;399(6732):166-9.

Conley et al., Characterization of cis-acting elements in light regulation of the nuclear gene encoding the A subunit of chloroplast isozymes of glyceraldehyde-3-phosphate dehydrogenase from Arabidopsis thaliana. Mol Cell Biol. Apr. 1994;14(4):2525-33.

Elbashir et al., Duplexes of 21-nucleotide RNAs mediate RNA interference in cultured mammalian cells. Nature. May 24, 2001;411(6836):494-8.

Faktor et al., Functional dissection of a bean chalcone synthase gene promoter in transgenic tobacco plants reveals sequence motifs essential for floral expression. Plant Mol Biol. Dec. 1996;32(5):849-59.

Fire et al., Potent and specific genetic interference by double-stranded RNA in Caenorhabditis elegans. Nature. Feb. 19, 1998;391(6669):806-11.

Fire, RNA-triggered gene silencing. Trends Genet. Sep. 1999;15(9):358-63.

Fitzgerald et al., Simultaneous silencing of multiple genes in the apple scab fungus, Venturia inaequalis, by expression of RNA with chimeric inverted repeats. Fungal Genet Biol. Oct. 2004;41(10):963-71.

(Continued)

*Primary Examiner* — Li Zheng

(74) *Attorney, Agent, or Firm* — Kevin Markham

(57) ABSTRACT

The present invention concerns methods for controlling fungus infestation via dsRNA mediated gene silencing, whereby the intact fungus cell(s) are contacted with a double-stranded RNA from outside the fungal cell(s) and whereby the double-stranded RNA is taken up by the intact fungal cell(s). In one particular embodiment, the methods of the invention are used to alleviate plants from fungus pests. Alternatively, the methods are used for treating and/or preventing fungal infestation on a substrate or a subject in need of such treatment and/or prevention. Suitable fungal target genes and fragments thereof, dsRNA constructs, recombinant constructs and compositions are disclosed.

16 Claims, 49 Drawing Sheets

(56) References Cited

OTHER PUBLICATIONS

Figure 1A:
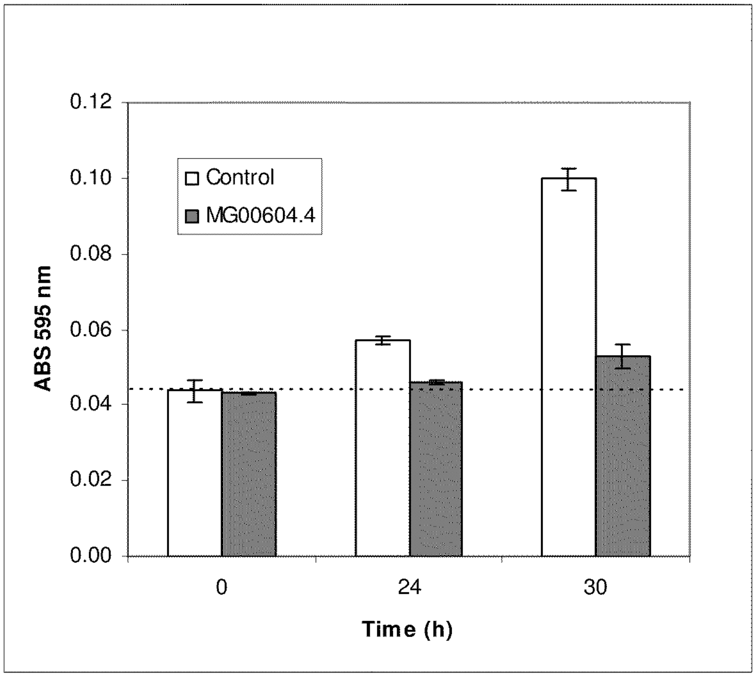
Figure 1B:
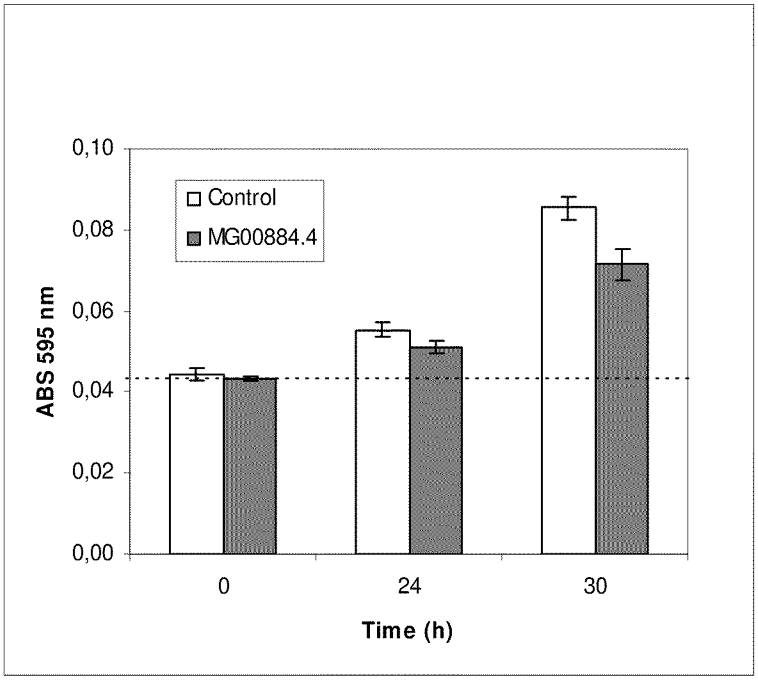
Figure 1C:
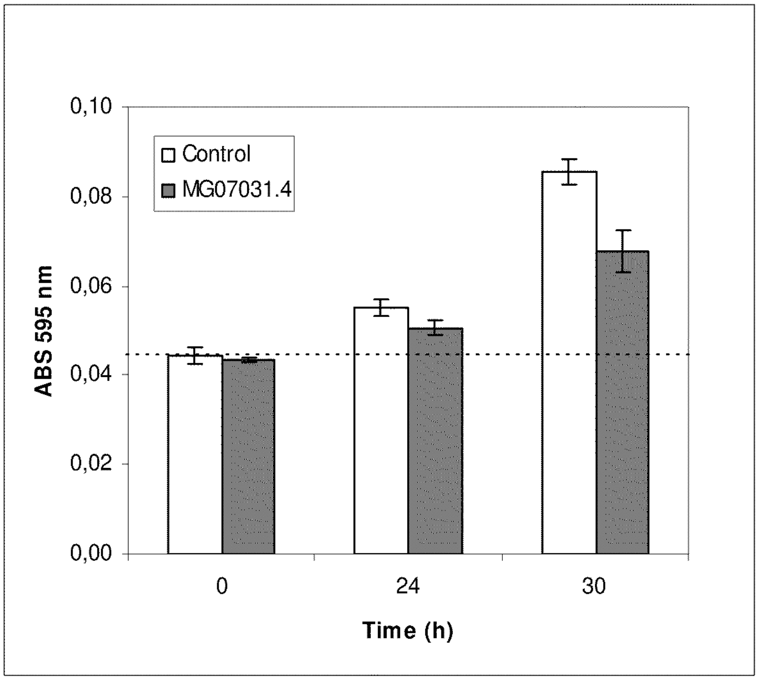
Figure 1D:
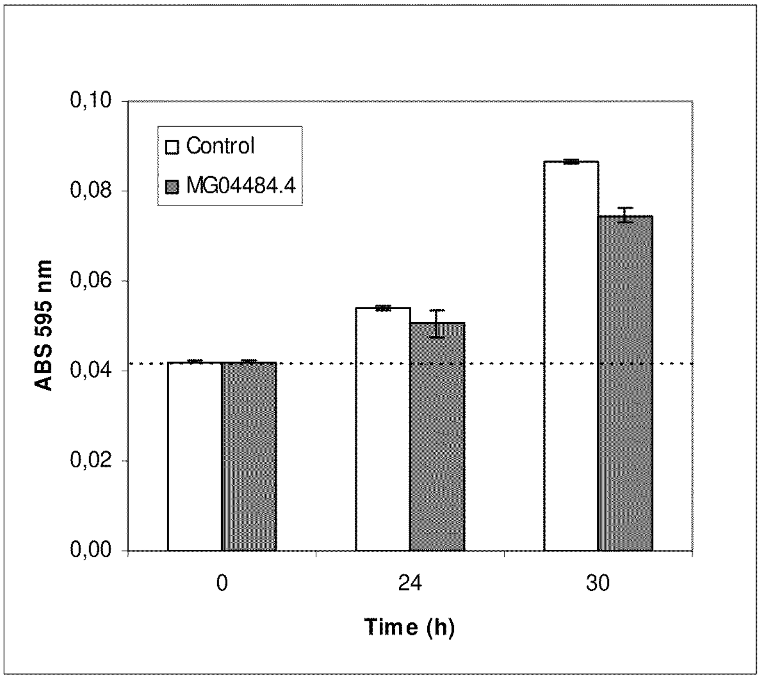

Fordham-Skelton et al., GUS expression in Arabidopsis directed by 5' regions of the pea metallothionein-like gene PsMTA. Plant Mol Biol. Jul. 1997;34(4):659-68.
Kadotani et al., RNA silencing in the phytopathogenic fungus Magnaporthe oryzae. Mol Plant Microbe Interact. Sep. 2003;16(9):769-76.
Kwon et al., Identification of a light-responsive region of the nuclear gene encoding the B subunit of chloroplast glyceraldehyde 3-phosphate dehydrogenase from Arabidopsis thaliana. Plant Physiol. May 1994;105(1):357-67.
Liu et al., RNA interference in the pathogenic fungus Cryptococcus neoformans. Genetics. Feb. 2002;160(2):463-70.
Manche et al., Interactions between double-stranded RNA regulators and the protein kinase DAI. Mol Cell Biol. Nov 1992;12(11):5238-48.
Mouyna et al., Gene Silencing with RNA Interference in the Human Pathogenic Fungus *Aspergillus gumigatus*. FEMS Microbiology Letters. 2004; 237(2): 317-24.
Nakayashiki, RNA silencing in fungi: mechanisms and applications. FEBS Lett. Oct. 31, 2005;579(26):5950-7. Epub Aug. 24, 2005.
Naqvi et al., Identification of RAPD markers linked to a major blast resistance gene in rice. Molecular Breeding. 1995; 1: 341-348.
Nomura et al., The promoter of rbcS in a C3 plant (rice) directs organ-specific, light-dependent expression in a C4 plant (maize), but does not confer bundle sheath cell-specific expression. Plant Mol Biol. Sep. 2000;44(1):99-106.
Rice et al., EMBOSS: the European Molecular Biology Open Software Suite. Trends Genet. Jun. 2000;16(6):276-7.
Sharp, RNA interference—2001. Genes Dev. Mar. 1, 2001;15(5):485-90.
Stahl et al., A sugar beet chlorophyll a/b binding protein promoter void of G-box like elements confers strong and leaf specific reporter gene expression in transgenic sugar beet. BMC Biotechnol. Dec. 5, 2004;4:31.
Stark et al., How cells respond to interferons. Annu Rev Biochem. 1998;67:227-64.
Timmons et al., May 12, 1998 East Cost Worm Meeting. http://www.elegans.swmed.edu/wli/[ecwm98p180]/. Abstract 180.
Zaidi et al., The Bt gene cry2Aa2 driven by a tissue specific ST-LS1 promoter from potato effectively controls Heliothis virescens. Transgenic Res. Jun. 2005;14(3):289-98.
Rost, B., Enzyme function less conserved than anticipated. JMB 2002; 318:595-608.
Devos et al., Practical limits of function prediction. Protein 2000; 41:98-707.
Asamizu et al. 2000, Genbank Accession No. AB016886, alignment A.
Yu et al. 1999, Genbank Accession No. AQ325089, See sequence search result B.
Thon et al. Genbank Accession No. AC123962, alignment attached as alignment D.
Birren et al., Genbank Accession No. XM_366870.

* cited by examiner

~~Figure 3~~ Figures 3A-3MM: DNA and protein sequences

FIG. 3A

SEQ ID NO 1(underlined sequence); SEQ ID NO 41 (complete sequence); SEQ ID NO 184 consists of the underlined sequence wherein the double-underlined/boxed nucleotides are deleted; SEQ ID NO 185 consists of the complete sequence wherein the double-underlined/boxed nucleotides are deleted.

<MG00170.4;DNA;Magnaporthe grisea>

```
ACCGTACATGATGCAATCGATGCATCTTTGAGCTGCTTGATTTGATAGGGACGGATTTACTCCGAACCAC
AGCAGCGACAGGAATTAGACGAGTGTCGCCAATTGAGTTGGTATGAGCTGCCTCCAATAGGAGAAATCAA
ATGATAGTGGGTCTGCCCGTGGGGGACAGACAGAGCTACTCCGGACCAGCTTGAATTTCAGGCTCTCAGG
CAGCAACTTGGAGCTTTCATTCACAAGGACGCGTGCATGGGTCTGCCTGAGCCAGAGCTTCGGACTGCCT
GCGTCAATCGAGGTGTACGTCTTATGGAACCCACCTAACCTCACCACCATCAACGTCCCCATCGATATCA
CAACTGCGTTCCCCTCTATCCACCCGCATCGAGACCATAATTCAACATTGGAAGATTCTCACCTCGGGAA
GTCTTCCGCTTTCGAAAGTGATACTTAATTCTACATCCATCACATAAATATTGGCGCCACGACGCCGGAG
ACTCGCCGCCATGGACACCCTGGTAGCCCGCTACAGCCGCCCGGCTTACCAGCAGAACGAGACATTCACA
GAAGATGATCAGCAAGACCTTTGCGATTCCGTCCCAAGTCTTTCACTCAAGTTTGCGGTTCCGCCAGTAG
CACATCCCTCATCTTGGCTCCGCACAGCAACGGACGACCACGCAAACCCAAACTGCCCCATCAAGATCGC
ACACGGAACGACGACGCTCGCTTTCAGGTTTCAGGGAGGCATCATCGTTGCGACCGACTCTCGTGCCACC
GCCGGCAACTGGATTGCTTCGCAGACGGTCAAGAAGGTCATCGAGATCAACTCTTGCCTGCTCGGCACCA
TGGCCGGCGGTGCCGCAGACTGCCAGTACTGGCTCGCCTGGCTGGGCATGCAGTGCCGTCTGCACGAGCT
CCGCCACAAGCGCCGCATCTCGGTCGCCGCCGCCTCCAAGATTCTCGCCAACCTCGTCTACCAGTACAAG
GGCATGGGCCTCAGCATGGGTACCATGTGCGCCGGCGTCACCAAGGAGGAGGGTCCCGCCCTGTACTACA
TCGACAGCGACGGCACCAGGCTTGCCGGCAATCTGTTCTGTGTGGGATCCGGTCAGACCTTTGCCTATGG
TGTGCTGGATGCCGAGTACAAGTACGACCTGTCGGATGAGGATGCGCTCGAGCTCGGCCGCAGGAGCATT
CTCGCCGCCACCCACAGGGATGCCTACTCCGGTGGTTTTATCAACTTGTACCACGTCAAGGAGGACGGTT
GGGTCAAGCACGGATTCAACGACACGAACCCTATCTTCTGGAAGACTAAGCTGGAGAAGGGCGAGTTTAC
CAACGTTACGAGTGCGCTGGACTAGATGTTTAACGAATTATGGCAGTATGATTGCCTTATTTCAAGCGTC
GACTCGGGTCTAGGCATGGCATTGGGAACAGGATGACGGCTGTGACGAATCACAAAAAAGTTACTCAAGC
TGGGTGTGATGGTGGGCAACGGGATACTCTGTTGTCTGGTCCCCGTGCGTGCACAGGAATCCGTACCATT
TTCTCATCTTTCCCTTTCCCCCTTTTTTTTCCGGAAGGCGAATGTCTCAACAACGTGTACTCAAAAGACA
CCAGGATCGTTTTACAGGAATTGGCGCTTGGTGACAGGCCGGTTTTAGACAACCCATCTAGCTGATTATG
CAAGTTGGACGAATCATTCCTCAGTAGGTCACGATGATATAATTGCCAGAGAAATTCTGTGAAGAGCCGC
CAAGGTTTGTAGTTATACTTGACTTGATTTCCATACTGCACATTAGGGCTGCCAGTACCTACTCGCTGTC
ATTGCCGTCGTCGAGAGCTTCATCTTCCTCTTCCG
```

SEQ ID NO 3 (underlined sequence); SEQ ID NO 42 (complete sequence)

<MG00884.4;DNA;Magnaporthe grisea>

```
AGGAAACGGTTTACAAATCGCAACCTGGAAAGCGTTTCTTTTTGCCCTTTTCGTTTGACTCGCCAAAAAG
TGCACTCCGGTCTTTAGGCCACCAACGGACCTTCCGTAATCACGCACGCACAGTCAGTCAGTTAGGCAAG
CCAGTTGCAAGTTGCGCGCCTCGCGAGCTTGGACCCGACCTGATCTGAACTTGACCCAACCCCGAACCAA
GCAACGAAAACAACTACATACCATCCATCTACCTACACAACGTAACACCCATCAAACTGCACCCAACAAT
CCACAACCGAACACCCTCGATCTGTCATCATCATCAACTCTCACTTATCCTCGTCTCCCTCTTTTTCCCA
CTCCCGCTGCATCCCGCTCGCTTCGTCGCCCACGCTACCACAAGCCGAACAAGTTATTAATCACAGCCCG
CGGATAACGTCATGCCAGGGAAGACTCCCAACGGGAAACAGCCGGTTGAGAACGGCATTAGGAAAACACA
GGACGTCGACATGAAGGACGAGACATCACGAAAGACCAAGGGAAAGAAGCTCAAGGAGGGTGACGAAGAA
ATGACTGTCGTTGTACCGCCGTCCAAGTCGTCCAAGCAGTCGCCACCGACCCGATCGGACGAGGACGTAG
ACATGGACGAGTCTGGAAAGGTTGATGATGCCGAAGTCAAGGTTGACCCAGCAGTTCAGGCCGTCGCAGA
TATCAAGAGCAATTTCGCCCTGTTGGACAAAGCTGTTGCTTTGTTCGATGCAAGATTCACGCTGCGTGCT
CTGCGGTCCATTTCATCCATCCGCAAACGGTTGACCGCCGACATCCTCGCCCAGGCGATTGCCGAGACGT
TTCCTCCGACCGCAGCGTCAGGGGACGCAGTCAAACAACTGCTCGCGAGCATCGGCAAGCAAGACGTGCA
ACTCGGACGCCAGTCGGGCTCTGAGATGGAGATCGATGGCGAGGTCAAGGGCCAGTCAAAGACGAGCAGC
TCTAAGAAGGAGAGCAAAGAGATCATCCCAGAGATTGACATCTTCATGGGAATCCTCACCCAGGTTTTCC
```

FIG. 3B

TCTATGATTCTAAGCAGCTTGAGCGCGGAGCCGAATTCTCCCAGCACCTTTGCGAACGGATCCACTCCCT
CAACCGTCGTACACTAGACTCGCTTTCGGCCAAGGTTTACTTTTACTACTCGCTCTTCTTCGAGAAGCTT
GCGCCTCTGCCGCCGTCTCCGCAGTCGCCATCCGTGTCTATCCGCCCAACCCTCCTCGCCGCCCTCCGGA
CTGCCGTGTTGAGAAAGGATATTGATACACAGGCCTCGGTCATTGTGCTGCTGCTGCGCAACTACCTCGC
CACGTCGCACATCAACCAGGCCGACCTGCTCGTCTCACATACACAGTTCCCCGAGAATGCTGCAAACAAC
CAAGTTGCGCGGTATCTCTACTACCTTGGTCGGATTCGCGCCATACAGCTGCGCTACACGGAGGCACACG
AGCACCTGACGGCTGCGACGCGGAAGGCACCGAGCTCTAACTGCGCGGTTGGTTTCTCGCAGACGGCCAC
CAAGCTTTTGCTGGTGGTTGAGCTTCTTATGGGCGATATTCCTGATCGCGCGACCTTCCGCCAACCGACC
CTCGAGGAGGCACTGCACCCTTACTTCCTGCTAGTCCAGGCTGTTCGGGTCGGTAACCTCGACAACTTCG
AGACGACCATTGCGGACCACGCCGATACTTTCCGCAAGGACGGAACCTACACCCTCATCCTCCGACTTCG
CCAGAACGTTATCAGGACGGGTATTAGAATGATGTCGCTTTCGTACAGCCGCATCTCGCTTCGTGACATT
TGCATCCGGCTTCACCTCGGCAGCGAAGAGTCAGCCGAGTACATTGTTGCCAAGGCCATTAGGGACGGTG
TCATTGAGGCCACCCTGGACCGCGAGCACGGCTACATGAGGAGCAAGGAGGTCGGTGATGTGTACGCCAC
GCGGGAGCCAGGCGAGGCTTTCCACGATCGCATCCGTGCCTGCCTCGCGCTCCACGATGAGAGCGTCAAG
GCCATGCGCTTCCCCATGAACCAGCACCGTCTTGAGCTTAAGAACGCTCAAGAGGCGCGTGAGCGTGAGC
GGGAGATGGCCAAGGAGATACAGGATGGAGATCTTGACGAGGACGACCTTGGGGGAGAATTCGAGGGCAT
GTAATATTCTCGATCCTCTTTTTATTTTTAAATCCCCCACCTTTTGCTTGCCTTAGAGAGGTTCCAACCT
GTGTTTTTGTACCCCTCGCATTTGTGTAAAGCTTTCTTCAACCCAAACGTGTACTTGTTATCACACTTTA
CCAAAGAGCTTATTCAAACTGGAATCTTTTACCTTTCTTGCGATTTCTGAGTCCAGCATGTCTCTTTGTA
TCTGGGCACAAGAAGTTGTTTCCATTCTTTGGTGATGAGGAAGGGGACAAATGGGGGTGGGGTTTTTGGC
GCGGAGTGGCTACGGCAATGGCGACGACTTTTCTTTTCTTTTCTACACAGTAGGGAATGCTCTGTTTGCG
CCTTATAATCGGGAACACATGGTAATCAAATGAATGGGTGGGTAGGGTATAACGGTATGCGGTATGGGGC
GGATTTGGGTTCCAGGGCTTTTGTGTTCAGTCACTATTTCGTTCTTTTCCTTGCGTTTTTTTTTTTTTTG
CCCCATCGCTTCCA

SEQ ID NO 5 (underlined sequence)and SEQ ID NO 43 (complete sequence) wherein the first double-underlined/boxed nucleotide may be a G or A, and the second double-underlined/boxed nucleotide may be present or not.

<MG07031.4;DNA;Magnaporthe grisea>

CGGCAGTCTCCCCTTCACGCTCTGAATCGTCGTCCGAGCCGGAACCAGCCTCAAAGTCATCTGCATCCTG
GTCCTGGTCATTGTCGGAGTCGGAGTCGCTGCCTGATATCGATTCGTCACGTTCCACCCTTTTTTTGGCC
GGAGCTGCGGAGCTAGCCTTGTCTCTTGATTTGGACGGCTGAGCTTTCGACGGCCTAGAACCGCTGGTTG
CAAGTCTCTTTTTGGGATTTTCAGGGGCTCCGGTACGTTTTCGCTTTTGAGCGCCGGGGACAGTAAAAAA
AGAAGACATTGTTCTGTTGAGAAGCCTTCAATGGGTGGAGGTTGTAATACTACCTCGTCTGCATCTTGGG
AGACTTTTTTTTTTTTTTTTGCTGCGGTCTCCTCCCAAAGGCGGTCCAGCGCATGTCGCCCGAGAAATTT
TTGGCGGGGAGTACAGTCAAAAAAAAAGTCGCTGAAATCATTGGTGGGGCAGTGAGTTAATCCTATTGGT
TGTCAGTTACATGGGTAGCCTGATCGGATCATTTTCCTGGGTCAGCCCCACCAAAGTTGTTCCGGCAGGC
GGTAGCGGAGCTTCGCAGAACACACTCAATATGGAGGTTCTTTTGGGGATCACGGGCAAGGACTTCACCT
TGATCGCAGCRTCCAAGGCTGCGATGCGGGGAGCCACCGTTCTTAAGGCATCTGACGACAAGACGAGGCC
ACTCAACAAGCACACCATGATTGCATTTTCGGGCGAGCCTGGAGACACCATCCAGTTTGCGGAGTACATC
ATGGCAAACGCGAAGCTCTATTCGATGCGTAACGAGACCGATCTTTCACCGTCCGCATTGGCGCATTACG
TCCGTGGCGAGCTTGCCTCGAGCTTGAGGTCGCGGAAGCCATACACAGTCAACCTCCTCTTGGGCGGTGT
CGACCCCATCACACACAAGCCGAGCCTCTACTGGCTGGACTACCTTGCGGCTCTGGCGCCGGTCCCATAT
GCTGCGCATGGATATGCTCAGTACTACTGCCTCTCCATCCTCGACAAACATCACCATCCCGATATCACCC
TGCACCAGGGTATCAAGATCCTGACTATGTGCACCGACGAGCTGAAGAGGAGATTACCGATTGACTTCAA
AGGAATGGTGGTGAAGGCGGTGACAAAGGATGGAATCCGAGACATCGAATTTGATGATGACAAGATTGTC
AAGAGTGCTTGAAGCTGTTTGTCGGAGCCAATCCCCGGCACCTTCTTCACGTCATTTTCGCGGACTGCAG
GCGCTTTGTACTATTAGAATCGGCGTAGACTGGACTGGGTTTTAACGGCGACAGAAAATCAATGACAATC
ATGATGAAATCAGTACACCTAGTTAGGATGCTACCGGGTGGTGGGTTGCCCATAGGCGGAAGTGCAAGTG
AGAAGCTAAATGTGACAACGGTAATGTTATAGTATGATGTTACAATTAAAATAGTGAAGCATACTGGGGT
CAGGGCAGGGATTGCGCTGTTAACATCACAATGTACGGTCCATGACCTCGTTCTTAATCTTCGTACGTGT
TACGTCGTAGGTTATCTACCTACCTCGCTAGCATGCCTGATGAGAATGGACGGACAGAGGTCACGACAAG
AGTCGCGTTTAATCTTGTAGAATAGTGTATATGATGATTTCAGATAAGTGAGGTAGGTACCAAGGTATGC
AGAACTATAGGTACCTGATTAA

FIG. 3C

SEQ ID NO 7 (underlined sequence); SEQ ID NO 44 (complete sequence) SEQ ID NO 186 consists of the underlined sequence wherein the double-underlined/boxed nucleotides are deleted; SEQ ID NO 187 consists of the complete sequence wherein the double-underlined/boxed nucleotides are deleted.

<MG04484.4;DNA;Magnaporthe grisea>

AGCCTTTGCTGTAATTTATTTTGTATGAGTTTCATTTGTGGTTGAGCTAATAAGAGTTAGACATTGTAGA
ATGAAGTTTCGACTTATTGGAAGCCTTGCTGTGCCTAATCTGACGGAGGCAATTGGGACCTGACCAAGAG
GGACGGTTCCAGGATCAAAATGCATCTTGACTCGTTAGACCCGCAGCACGTGAGCGCCCTGAATTATCTC
TTGTTGCAGCGCGGCCGTGTTTTACGCAGTCAATTAGCGTAGGATTAATGCCTTACATGTCAGGCGCAAA
GCGAAAGACACACACGAAAAGGAGCTGCCCTAATTCTGCCCAGCCGAATTTCACCGCCCCGCCGCTCGCG
AATTGCCCCACAAGCGCACCACCACAACGAAATTTCCATTGGCATCGTGGCCGTTTGCAACTTTTTTGT
TCTCCCTCTCCAACTAACCAGCAGCAAATCAACCGCCCACCCGTCCTCGTAGATCAGCGACATCGCGAGA
CGCCGACAAGATGGGTATCGATCTTAAGAAGCACCACGTGCGCAGCACGCACCGCAAGGCCCCCAAGAGC
GACAATGTCTACCTCAAGCTCTTGGTGAAGCTCTACCGCTTCCTGGCCCGCAGGACCGACTCCAGCTTCA
ACAAGGTTGTCCTTCGCCGCCTCTTTATGTCGCGCACCAACCGCCCTCCCGTCTCCCTGTCGCGCATCGC
AGGCAACCTGAAGAACGGCAACGAGAAGAAGACCGTTGTCGTTGTCGGCACCGTCACCGACGACAACCGC
CTGGTTGAGTGCCCCAAGGCCCAGGTCGCTGCCCTTCGCTTCACCGCCACCGCCCGTGCCCGCATCGTTG
CCGCCGGCGGCCAGGCCATCACCCTTGACCAGCTGGCTCTTGAGAAGCCCACTGGTGCCAACACCCTCCT
CCTCCGCGGCCCCAAGAACGCCCGTGAGGCTGTCAAGCACTTCGGCTTCGGTCCCCACAAGCACAAGAAG
CCTTACGTCCAGTCCAAGGGCCGCAAGTTCGAGAAGGCCCGTGGTCGCAGACGATCGCGTGGTTTCAAGG
TCTAAATGGCCTTGTCATCCTCTTTTGGGGTCTCTTTTTGTTTTTATTCAATGGGCTTGTTACTGCTGGC
TGTTCTCGTGGGTTGACGCAAGAAAACGATATCCATGTTGTCTCTTACGGTCGTCTTTGGGGACTCTTTA
GTCAGTACTCTCAAACAACAGGAGTTTGCATGGGTTTCGGCGTGGAAATGGGCAACAAAAGAATATTCAT
GAACTTTCGGAATGCAAATATGAAATTGAGATGCCCTGAGGCCCTTGAATCTTATACTATTTGCGTGTAT
GGCTGTGTTGTATGTGCTAGTGCAAGTGAACAATCTGTAGGGAGCAATGTGATGTGGA

SEQ ID NO 9 (underlined sequence); SEQ ID NO 45 (complete sequence); SEQ ID NO 188 consists of the underlined sequence wherein the double-underlined/ boxed nucleotides are replaced by "GCATCGCCGTTGGTCGCCAT". SEQ ID NO 189 consists of the complete sequence wherein the double-unerlined/boxed nucleotides are replaced by GCATCGCCGTTGGTCGCCAT.

<MG02946.4;DNA;Magnaporthe grisea>

GTAGGAGCTCACATGAAAGGCCTCATGTCTGATGGCTGGCTTCTATGGTAGTTCACTATGTATACCTTAG
GGCTAGAGTACAAGTGCAGGGTAGGTAGTAAGACAGTCACTTTGATTGTGGTGCAGGGTAGGTACGCGTA
TGTGGCTGTCAAGCACGGACCCATATACGTGCGACAACGGACCACTGTCAATAATTTTTGCTGTTGGAAA
CGGACGCGACTGATATCCACCGCGACAAGTAACGCCGACCCACCCAGCCGACAACCTACCGTCGCAACTT
CGATCAATACATCACGTTTGACGCAGCGGAATCCGGCAAGATACGAATCCTTCATCAGGATATCGATCCG
CAACACCAATGGACACATATTGAGCAGCGGACTCAATTCGTAAGGACTACCAGATCGAGCCGAGCGACAT
AGAGCAGAGGACAAGAAAACCTCGTCGTAGTAGGCCAAGGCCAACCCCGTCTCCCGAAAACAAACAGTCG
CGCTTGCAACATGGCGACCAACGGCGATGCTGCTCCCCCGGCGCCGGCGGCAGAGACGGCAGCTGCGACT
GCGGCCGCGGCACAGCTCGACGGCCTCAGGCCTCCCGAGGGCGTCATCATTCCGCCACCCGGTGAGATCC
GCGAGGTGATTGAAAAGACGGCCGGGTACGTGGCGCGTGGTGGACTGGGCATCGAGCAGCGCCTACGCGA
GAACCACAGCGGGAACCCAAAGTTCAGCTTCGTCACGAGCCAGAGCGACGCGTACAATCCGTACTACGAG
TGGCGCAAGGCCGAGTACAAGGCCGGGCGTGGCACGGCGCTGGCGGCTGGTCGGGCGGATGCGGCCGCGT
TGGCGGCCGCCAAGCTGGCAGAGCAGAACAAGGAGCCCCAGGGCCCGCCCAAGCCGCCGGATTTTGAGTT
CTCGGCGCGCATGCCGAGGATGAACCAGAAGGATCTTGAGATATTGAGGGTCACGGCGCTGTTCGTGGCC
AGGAACGGAAGGCAATTTCAGACCCAGCTAATGCAACGCGAGACTAAGAATCCGCAGTTTCAGTTTCTTA
TCCCGAATCACACCTTCCACAATTTCTTCCAGCATATGGTAGATCAGTACGCCATCATACTCAAGGAGAG
TGGCATGGGAGGGGATGGATCTAAGGCCCAGGAGCAGCGAATTGAGCAGCTGCGGCGCAATGTCGAGGAT
CGGTTCCACATTCTGGAGAGGGCAAAACAGCGGGCTGAGTATGCAGTATGGCAGGAGCAGGAGAGGCAGA
AGCAGGAGGCTGCCGAGGAGAAGAAGAAGGATGACTTTGCACGCATCGACTGGAATGACTTTGTCGTGGT
TGAGACTATTGATTTCACCGAGGCAGATGCCAATATTACCCTCCCACCGCCGACGACTCTCAACGACATA
CAATACGCATCATTGGAGGAGAAGCAAAACTTCTCAGTCAACGCCAAGCGTATCGAAGAGGCATTCCCCT
TTGATGATACCAGCTACAATGCCTATCCGGTACAGCAACAGCAATCACAACCAGCACAACAAGACTCACC

FIG. 3D

GGCAGGGGCACCGGCACAGCCGGCACACATGCAGCAGGACCCCGAGGAGACGCGGAGGATACAAGAAAGG
GAACAAGCCCGGGCGCGCATGCACCAAGCCCAGGCAGATGCCAGAGGAGGAACGGCTCCAATGAAGATCA
AGGAAAACTACGTACCCAAAGCGGCTGCCCGGGGTCCGAGGACCGGAGGCCAGACGGCTCTGTGTCCAAG
ATGTAACCAGCAGATCCTCTTGTCGGAGTGGGAGGAGCACATGAGGATCGAACTGCTGGATCCCAGGTGG
AAGGAGCAAAAGGCCAAGGCAGAGTCGCGATACGCGACGACCAACATATCGACGGCGGATGTGGCCAACA
ACCTGAAGCGTCTGGCGAGCCAAAGGACGGACGTGTTCGACAGCGTCACGGGCCAGCCGCTCTCGGAGGA
GGAGATGGCCCGTCGCAAAAAGGCAGCCATCAACAGCTACGATGGAAACCCCGACGGCAAGAGCCAGGCG
CACATTGCACACCTGCAGCACGTCAATGTCGAGGAGCAGATCAGGGCTATCCAGCAAAAGTTTGGAGACA
AAAAGGAATAATTCTGCGTAACAGCAGGGTAATGATGGTGTTGCACTTTTTTATGTTTGAAACTGCTATG
GTGTTCGTCTTATACTGCCAAGCTTGCTAACAACTTGACCTATTTATGTACAAAACAAGATCACGGTTAC
TGCTGCCCAAGAAAGGGCTTCCAACAAAGGGCATGTCTCATTGGTGCGTCAATCTAGAACGCTAGTATAA
GTTCGTCACGTACGTATTTAGGTATCTGACTGTCCATCACTGGCGATCTCGATGAGTCCAAAATTTGCCT
TGAAGCCAAGATTCGCTAAGGCACCCTTGATTACCGAATACCACCTAGAATCCAATGGGGAGTACCATGT
TCTACCGCCCCGCCGACGCCTACTATACAATACAAACGCGGCGTGCGGTGCATTGCATACGAAGCATATA
TAAGACTCGGGCAATGTAAGAGTTTGCGGCAGGCACCCGATCGCCCCCACATTTAGATGATTTCAAATGG
TGCAATATTCCGTTGACAGTT

SEQ ID NO 11 (underlined sequence); SEQ ID NO 46 (complete sequence)
<MG07472.4;DNA;Magnaporthe grisea>
GAAGATTCCGCGAGGCCCACCCAGCCCGCCGCCGCCCGTCATGCACTCGCCGCCGCGGAAGTTGACGGCT
CAGGACCAGGAGGACTGGAGGATACCGCCGCCAATCTCAAACTGGAAGAACCCCAAGGGTTTCACGGTAC
CGCTGGACAAGCGTCTGGCCGCCGACGGGAGGGGTCTACAGGACGTCACGATCAACGACAAATTCGCACA
GCTATCAGAGTCTCTGTACGTCGCCGACAGACATGCACGTGAGGAAGTTAAGCAGAGGGCGCTCATGCAG
CAGCGCCTGGCAGAGAAGGAGAAGGCCCAGAAGGAGGAGAATCTGAGGCAGCTGGCACAAAAGGCGAGGG
AAGAGCGTGCCGGTGCCGGAAGCAGACGACGGTCCAGGTCTGGCAGCCGCAGCAGCCGATCCTATTCGTC
TGGCTCAGACAGCGAGGAATCTGACATCCGAGAGCGTGAGGAGGCAAGGAAAGAGCGACGCAAGGAGGAG
GAACGCAAATTACGACAGTCTAGGATGGGAGCGGAGAGGAGAGTACAAGTCATGGCACGGGAGCAGAACC
GAGATATTTCTGAGAAGATTGCGCTGGGACTCGCCAAGCCCACGCAGTCGTCAGAAGGCATGTACGATTC
TCGACTTTTCAACCAATCATCTGGTTTCGAGGGCGGCATCAACGAGGACAACCCTTATGACAAGCCGCTT
TTTGCTGTTCAGGACGCCATCAGTAGTATCTACCGGCCCCGTGCGAACAACGATGATGAGGACGAGGCGG
CTGGCGATGCGGAGATGGCCAAGATACAAAAGGCGAGCAGATATGGTGAGGTGCTAGGCCGAGGTACATT
CTCCGGTGCCGGGGATGTGGAAGCCCGAGAAGGTCCAGTGCAGTTCGAAAAGGATGCTGCAGGCGCGGAC
CCTTTCAATGTGGACAAGTTCCTGTCCGAGGTCGAACAGACCGCGTCATCAAAGAGGGGTTATGGTCTGC
AAGACTCGAGCAACGATGGCGGCAGGCCGAAGAGGGCTAGGGTGGAGGACGACGATTGAAACTTGTTTGA
AAACACTATAGGGCTCTTGCAAAGGCATTACTTGTTTAATGGGACCAGCCATGAATTGATACTATTTACA
GATCATTATGGGTAGCAACGCTCTTGTCTGATCTTACCAATCCCTTTTCCTACGAGGGCTAAACACAGTG
TTCTCATCGCAGAAAAGAGCCGTTCGTGGATGAAGAAAACATGTTATCCGTATCAGCATTCTTCGTCAAG
GGCTTACGGGCATTTTAAACTCGTACTCCTTACTCTAACGTCATCTCTTGTCGTGCCATATCGTATCGTG
TCAAGCCACACTATCTCGAATCTCAAAAGATCGACAACTGTGTAATTGGGCAAAGCTAAAGTAACTTGCA
CTCTTTTTTTTCCTGTTGCTCTGGCCCAATCCTTTTCATTCAACGTTTCTTTCGCGGTTGGTCGTTTGTT
TTGAATCGGAATGATCGAGTCGTGCACGACCGTCATGCACCGGCACGATGAATCAAAAGCTCCGAGTG SEQ ID NO 17 (underlined sequence)and SEQ ID NO 49 (complete sequence)
wherein the double-underlined/boxed nucleotide may be a C or T.
<MG06292.4;DNA;Magnaporthe grisea>
TGGTTTTTTTCTGGGGCGCGTTTGTGTACGTCTGACCGACGAACAAAGAACACCCCACTCGCTCTTCCAC
CCTTACACAATAACTTTGGGGTCGCCTTTGGCAAGAATAAATTTGCCTAACTTACTTACGCAAAGCTCAT
CTTCGTCGAGATTTACATATCCGTAATTATTAATGGTTTTTTGCGTCTAATCATCCCATAAAACCCGTCG
ACATCGAGGCGCCACCAGCCTGGTCGCCATAGCAAAACGACGTCCTCACGCGCCCGAACATAGACACAGG
CACTTTGGTCGCGGTTTTCGGTCGCGTAAAACCTGGCAGAAGCCTCCCGCGGCGAATACAGAGCGACGAA
CCCGAAGCGCGTTTGTCGGCCTTCGATTTGGGGTGGCAAAGGTACCTTTGGTCCTGAGCCTCCTCCTTAG
CCTGATCCCATGGCTTGGCATGTCAGGTAGCAGTCTACGAGCATAGTCGAATGTCACGGCCCTTGGTACA
GTCCGCTGCCATGGCACCTGGTAGCAGTGGTGCCAATGTCGCAGCACTGTTACGACACGCAGTGCTATAC
CACCTCGACAACAGTGCACACGAAAATGCGCTCTTTTTCGCCGAAAGACTCGCTGCTCAGGACCCTCGAT
CCCCCGAATCAGCGTTTCTCCTTGCCCTCTGCCATTTCCGCCTGGGAGATTTTCTGTCGGCGCACGATGC

FIG. 3E

CAGCAAGGACGACTTGAAGGGAGCAGGCCTTCGGAGTTTACATATAGGGCGGGCCTACATATTTGCGCAG
AGCTGCTTGGCACTAGAAAGATATCGAGATGGGGCTATCGCACTGGAGAGGTGTCGACCGCAATGGCCGC
ATAAAACCACTTTTGGGAAACACACGGCCTCCACGCGCAGCCTGATACCTGATGCTGCCGCGCTAAACTG
CCTGCTTGGTAAGCTCTATCAGGGGCTTGACGACAAGAACAGGGCTGTATCCTGCTTTGAGGACGCACTG
AAGCTGAACCCTTTCATGTGGGATGCCTTCACATCGTTGTGTGACATGGGTGTTCACATCAAGGTTCCAA
ACATATTCAAGGTCACCGACAAGCTTGTGCGGGCTCTTGATTCAGAAGATAAACCCACGATTAACGACAA
GGAAACATCTTCAGCAGCTACATTAGAGCCGCTGCCGAGAAAGTCAGCTTTGCGTTCGGCCCCCGCAGAC
ACCTCGGATCCCTTCGACCAACCAAGAGCAGTCGCCTTCCAGGACAGACAGGCACTCGGGAATCTGGTAG
CCGCCGAGACCGAAGAAAATGAGTTTCTCCAAAAGATCGCAGCTGCTCGCTCTAGGATGGCAGCAGCTTC
AGGACCAAGCAGTGCGAGTGATCTCCTAGACACTCCTCCAGCTCCTTCGGCTCCGGTGGAGATAAACGCC
TTGCGTGGAGGGGCTCATCCTGAGCCTCCGCACGCGCCCATGCGCAAAACTAGGGCAGCGCATACTATTG
AACCACCTCCTTCGGATGCCCCGCCAAGGATGGGATATCGTGGCATCACTAAACGAAGAGCAAATTTGGA
CCCCAACTCAGAAGCCCCTTCAGCCACGGAGCAGCCCGYTTCCCAGATGCTCAGAACTTCAGCGTCATCA
CTGTTGGGAGCTGAACAGCGGAAGCGGACCATATCTGGGCATCCAGTCCAATCCAGGCCAGGTGTTACCG
AAGAACCCGGAGCACCACAGAGAAGAAGTGCCAGGCTCAACATGTTCAAGCAGCCCTCTACTGCCAAGCC
GAACGCTGCAGCTGCTCCCATTGGCACCACATCTACGAGGGAAATGAAGAAAGCCAGACCAGCCATCTCG
AGAATCATGCGGCCAGGGAGTAGCGGTTCTAGCGTTGGGAGGGTTGTGAGTGGGAACCGAAAGCCAGTGG
AGGAAAATACCATGGATGTTGATCATGTCGAGCCCCCGAAGATGAGAGATGCAGTTCAACCACCTCTAGG
ACCTGCAAGAACAATCGAGGCGGACGGACACAGCACAGTAAGATTAGAAGAAACCTTGCGGTTGTTGATG
GATCTTCTCAAACGCCTGGGAACGGATATTTGGCTTTGTCGCAGTACCAGTGCAGCGAAGCTGTGCAAG
CTTTCAGCACGATACCGCGAGCTCATGTCGACACCCCGTGGGTTTTAGCTCACATCGGACGCGCTCAGTA
TGAACAGACCAAGTATGCTGAAGCAGAGGCCTCCTTCAAGCGCTTAAGAACATTGGCACCGAATCGGCTG
GAGGACATGGAGGTCTATTCCACAGTACTTTGGCACCTGAAGAAGGAAACAGAGGCATCGTTTCTGGCAC
ACGAGCTTGTTGACATAGCGTGGCATTCACCGCACGCCTGGTGCGCCTTGGGCAATGCATGGTCGCTGGC
ATCAGATCGCGAACAAGCGCTGCGGTGCTTCAAGCGTGCTACGCAGCTCGACGCAAAATTTGCATATGCC
TACACACTTCAAGGGCATGAGCACTTTGTTAGTGAAGAATACGATAAGGCGTTGACATCATACCGGCACG
CCATAGCGGCGGACCGGCGCCATTACAATGCCTACTATGGCATCGGAAGAGTGTACGAGAAACTTGGCAA
CTATGACAAGGCATATACCCACTTCCATGCGGCCTCAGTGATTCACCCGACCAACGCGGTCCTGATATGC
TGCATCGGTACGGCACTGGAGAAGCAAAAGCAAGTTGTACAGGCCCTGCAGTTTTTCACAAAGGCGACCG
AACTAGCACCGCGGGCAGCGCAAACACGCTTCATGAAAGCGCGCGCTCTTTTGGCGTTGGGACAACTACA
CGAGGCTCAGAAAGAGCTCATGATCCTCAAGGACCTCGCACCGGACGAGGCGACTGTGCATTTCCTGCTT
GGAAAGCTCTACAAAACACTTAACGATAAGAATACGGCGGTCCATCACTTTACGATTGCACTGAGTCTGG
ATCCAAAGGTAAGCCAGCCGCTGCATGTCAATGTTGCTTTTCTTGGGCTACCCAACGGTGATGGCTGACA
ACCCCGAACAGGCCAGTCAATTGATCAAAAAGGCCATAGAAAGTCTCGAGGATGATGAATGTTATGACGA
CTCCATGGTGCAATGACAATAACAATAACAATGTTGCCCAAGTGTGGGCGAGGGTAACGGCTTTCTCTCT
CTAGAACTTGCTACGAATGTATATAACCGACTCTGAGATGAAACTCTTCACCCGTTAGCCCAATTGGCCA
CCAGGGAAATCAGTGGGACGTTGTTGCATGGCGTCTATGAAACGACACGAGAAGATATGAACCATCGATC
ATTTCAATCCATGGAAATGCAGCATTGCATTGGCGTTCTGGACATGCTATTTGCTGGGAAGCAAGCAATT
TGAGATTGTTTCTGGCCACTGAGTTCTGGGGAGAGCCATGGGATGGGACGGGAGGGCGCCTGGATCGGGA
GATAGTTGGGTAAGGCTTTGACTATGCGGTTGTGTTTTTGGGGAAGCGGTCTTTATTTTATTTTTTTTG
GGCGTAGG

SEQ ID NO 13 (underlined sequence)and SEQ ID NO 47 (complete sequence) wherein the second and the third double-underlined/boxed nucleotide may be a A or G and wherein the first and the fourth double-underlined/boxed nucleotide may be C or T.

<MG03668.4;DNA;Magnaporthe grisea>
CATACGGAGCAAAAGTTAGCTGTATCCAAGGGGATATGGAAAAGGCATACTCTTTTCTTTTCTTTTCTTT
TTTCTTTACTGTACTTGGGCCGTTTGGTCCAATCCACTTTATTGACCTTAGCCCAAACAATGCGGTTTCT
TTTCCCCCTCCCACACACACACACACACACACGCACACCACGGTTCTCACCGTTCCGTCATCCCACCTGC
ATCCACACGTGCATGGTACACAACCAAGCCAGCCCGCTTCTACGCAAACCATTATTTGCCCCTCACCTTT
ACTCCGACCCGTGTCTGCCTAGAGGCGGTATATTCCCTTATCCATCAGCAAACGCCGACACCAACAGACA
CGCTACTCGTCTAGATCAAAGCTACCGCCAACCTACCACATTTAACGGCCGACACTGCAAGTCAACTCGC
CCGCAAACTCGGATATTTGGCTGACTCTCGAAACAACAAACATCAGATAGCCTCTGTTGGGCAACAGCAG
AAGGCTCACCATGGCGACGTCAGACATCACGACGGTGCTCACAAATTCGCTGTCTGCCGATGCGAACCTG

FIG. 3F

CGACATGCCGCCGAACAGCAGCTCACACAGGCGGCTGAGACCAACTTTTCATTATACCTTGCGACTCTTG
TTACCGAGCTAGCAAATGAGAATGCCCCGGGTCACATTCGAGCTGCCGCTGGTATTGCGGTGAAGAACGC
GTTCACAGCCCGCGAGTTCAGCCGTCAAACTGAACTGCAACAAAAATGGCTTCAACAAACAGACGACGAA
ACCAGGGCAAAGGTCAAGAGTCTCACTCTACAGACCTTGTCGTCAACCAACTCCCAGGCTGGCCAGGCCG
CCGCCCAGGTCATCGCCTCCATCGCTGGAATCGAGCTTCCCCGTGGACAATGGGCCGACTTGATGAACAT
CCTCGTCACAAATGTCAGCGAGGGTCAACCCCACCAGAAGCAGGCATCTCTGACTACGATAGGATTCATC
TGCGAGAGTCAAGATCCTGAGCTCCGCGCTAGCTTGGTCGACCACTCCAACGCTATCCTGACGGCCGTCG
TCCAGGGTGCTAGGAAGGAGGAGACCAACAATGAGATCAGGCTGGCCGCCATCACTGCCCTCGGAGACTC
GCTCGAGTTCGTCGGTAACAACTTCAAGCACGAGGGCGAGCGCAACTACATCATGCAAGTTGTCTGCGAG
GCCACACAGGGCGACGACTCACGCATCCAGCAGGGTGCCTTTGGTTGCCTGAACCGTATCATGGCCCTTT
ACTACGAAAACATGCGTTTCTATATGGAGAAGGCGCTTTTCGGCTTGACCATTTTGGGCATGAAGAGCGA
AGACGAGGACGTTGCCAAGCTGGCTGTTGAGTTCTGGAGCACCGTTTGTGAAGAGGAGATTGCCATCGAG
GACGACAACGCACAGGTCGAGAGCGCGGATCAGGTCAGGCCGTTTTACAACTTCGCCCGCGTGGCAACCA
ACGAGGTGGTCCCCGTCCTCCTCACCCTTCTCACCAAGCAAGATGAGGACGCCGCCGACGACGAGTACAA
CATTTCTCGTGCTGGCTACCAGTGTCTGCAACTTTACGCCCAGGCTGTTGGTGGCACCATTATCCCGCCT
GTTATCTCCTTTGTTGAGGGCAACCTCCGATCCGATGACTGGCACAACAGGGATGCGGCTGTCTCTGCTT
TTGGTGCCATTATGGAGGGTCCCGACGAGAAGACTCTGGAGCCGATTGTCAAGTCCGCTCTGCAAATTCT
CATCTCAATGATGGACGACTCCTCGGTACACGTCAAGGACTCGACCGCTTACGCTCTTGGTCGCATCACC
GAGGCCTGCTCYGAGGCTATTGACCCCAGCCAGCACCTCGAGCCTCTGATCCGCTCGTTGTTTGCTGGCC
TGCTAAACACTCCCAAGATGGCCGCCTCGTGCTGTTGGGCTCTGATGAACCTGGCGGAACGTTTTGCCGG
TGAGCCCGGAGCGCCCCAGAATGCCATCACTGCCTACTTCAACGACAGTGTGCGCAGCCTCCTGGACGTC
ACCGCCAAGAACGATTGCGACTCGGCTGTCAGGACGGCCGCGTATGAGGTTCTCAACGCTTTCATCGTCA
ATGCGGCAAACGATAGTCTGCAGGCTGTTGCCACTCTTTCGGATGTTATCATCAAGCGCCTAGAGGAGAC
GATACCACTACAGACCCAGGTTGTCAGCGTCGAGGACCGTATTACACTCGAGGACATGCAGACCAGTCTG
TCGACTGTTCTTCAGGCCATCATCGGCCGTCTTGACAAGGAAATCCTTCCTCAGGGCGACCGAATCATGC
AGGTGCTGCTGCAGATTCTGTCAACGGTCAACGGCAAGTCCACTGTTCCCGAGGCTATTTTCGCCACCAT
CAGTAGCCTTGCCAATGCTATCGAGGAAGAGTTTGTCAAGTACATGGATGCCTTTGCGCCGTTCCTCTAC
AATGCTCTGGGTAACCAGGAAGAACCCAGCCTGTGCTCCATGGCTATCGGCCTCGTGAGCGACATTACAA
GGTCAATGGGCGAACGCAGCCAACCGTACTGTGACAACTTTATGAACTATCTCCTTAACAACCTGAGGAG
CTCAACACTTTCCAACCAATTCAAGCCTGCCATTCTGCAGTGCTTCGGGGACATTGCCAACGCCATTGGC
GGCCACTTTGAGACTTATCTGTCTGTTGTGGCTCAAGTTTTGCAACAAGCCTCCACTGTTACCACAGTAC
CCGAGGGCTCATATGAGATGTTCGACTACGTCGTCTCATTGAGGGAGGGTATTATGGACGCCTGGGGCGG
CATTATTGGTGCCATGAAGAGCGCCAACAAGACCCAAGCCCTCCAGCCTTATGTCCCATCCATTTTCGAG
CTGCTGAACCACATTGGTAGCGACTCGAACCGTAGCGAGTCTCTGATGCGCAGTTCCATGGTGTTATTG
GCGATCTTGCCGATGCCTACCCCAACGGGGAGCTCGTGGATGCTTTCCGTCAGGRCTGGGTTACTRCTAT
TATCAAGGAGACGCGTTCCAACCGCGAGTTTTCAYCGCGGACAATCGAGACGGCACGCTGGGCACGTGAG
CAGGTCAAGCGTCAACTTGGGGGTTCCGTCAATGTCATGCAGCAGACTTGAGAAGCTTTGATATCCGGTT
CCTAGGCAAACGGAAATGCCCTCGACAAGTGATAACCGGCCAAGGAAAAGTCAATCCAGTCCCAACCCGC
CGAGCCGGGCCCGGTGTCCCTATTCACCACCAGCCCAACCGCCAAACTCCATTTTTTTGAACGATCCGCA
ATACGAATGCGGACAATTATCATATGGCCCCTTCATATGGCCGGCCAAGGTCGACCCCGTCCCATCAAGT
CCCTTTGACTCGCACTGGAACTTGTTATGATGCGAATGTCAGCGCTTATCTTTTTTTATTTATCTGCAGA
CGTTCAGATTTGTTGGATGACGGAATGCACAACCATCACTGCCCGACTGCCCGACTGCAATAGCCCCCAA
AGTGAATGTATATAATTAGACCCTTGAAAAACCCCTACACTATTAATTTCGAGACCACGTCCAATCGACT
TTGTTGCCCCTTCATACAATCCTGCACTACCTACACACTACACCGCTGTTTTTTTTTTTTT

SEQ ID NO 15 (underlined sequence); SEQ ID NO 48 (complete sequence)
<MG10192.4;DNA;Magnaporthe grisea>
ATTTGCTACTTATTAACTTGATGATACATCATATGAACACAACAACCTTACTCGATGTGCAGGTTGTTTA
TTGATACGGCTCTTTTTTGATGGTTACGTGTTAGTTAGCTGACTTACCTAGGTACTTCGTAGCTGCACAC
CAAGCAGCCTAACACTCCCTTGCAGCCAGTGGCCATGCAGAACAAAAAGTTTGGGGCAAACCACACCAAA
CCGGAGCACTCGGGCTCATCACGTGATAGAATTCTGCTCGCCCAACCTTGCCAACCCAGTAAAGTGGGTT
TCAGAACCTGTTAGCCCACAAGTGAATCAGGTCAAAAAACTCTTTCGTGTGTGGGAGGGCCGCCGTGGAT
CTACTTTGGCGACGAACACCATTTGTGTCTTTGACGGAGCGTCCAGTCAAGTTATTTCGCTCCATCGCG
CCTGTGACTTGCGCCTCGTCTCTGACTACGTCTAACCTTCCTTTGCGTTTAGCAGACGCCTACAGGAAAG

FIG. 3G

GTTGCCCATCATGCCTCCTCCACCGCATCAAAAACCTGAAAATGTCCTCAAGCGCGCCCATGAGCTCATC
GGCGTCAACCAGGCCCCTGCCGCCCTGACTTTACTCCATGAGCATATAACCTCTAAGCGCTCCCGAAATG
TTCCCATCGCCTCGCTGGAGCCGGTTATGGTGCTCCTGGTTGAGCTTTCTGTGGAGCAGAAGAAGGCAAA
GCTGGCCAAGGATGCGCTGTACCAGTACAAGAACATCGCACAAAACACAAATGTCGGCACGATAGAGCTT
GTTTTGAAAAAATTCATCGAGCTCGCCGCAGGCAAGGTCACCGCCGCTCAGCAAAAGGCCGATGAAGTCC
AGTCTTCTATCGAGGCCACTAACTCCACAAGCGTCGACGACCTCGAAGCTACCGAGACCCCAGAGTCGAT
TCTTCTTGCAACTGTTTCCGGTGAGCAGTCGCGCGACCGTACCGATCGTGCCATTGTCACCCCGTGGCTG
AAGTTTTTGTGGGAGGCCTACCGCACTGTTCTCGACATTCTCCGCAACAATGCTCGTCTTGAGCTTCTAT
ACCAGAGCACTGCCATGCAGGCCTTTGAATTTTGCCTGAAGTACATCAGGAAGACCGAGTTCCGCCGCCT
CTGCGAGCTTCTTCGCAACCACGTTCAGACTGCCGCCAAGTACTCAACTCAGATGCACGCTATCAACCTG
AACGACCCAGATACTCTTCAAAGACACTTGGAAACCCGCTTCCAGCAGCTCAACGTCGCTGTTGAGCTCG
AACTCTGGCAGGAGGCTTTCCGCAGTGTGGAGGACATCCACACCCTGCTGAATCTGAGCAAGCGCCCGCC
GAAGAACATCATGATGGCCAACTACTACGAGAAGCTCACCCGTATCTTCCTCGTTGGCGAGAACTACCTT
TTTCACGCGGCCGCTTGGTCCCGTTATTACTCTCTCCTCCGTCAGTCGGCTGCCGTGGTTGCCAGCGGCC
AAGGCAAGAAGGCTGATAACCCACCTGCTACACCAGCAGACCTCCAGAAGGCTGCCTCTTTTGTTTTGCT
GTCCGCTCTATCCATTCCCGTGATCAGCACGACCCGTTCTCGTGGTGCAATGGTGGATTTTGATGAAGCC
AAGAAGAACAAGAACTCGCGTTTGACGCATTTGCTCAACATGTCCCAGGCCCCCACGCGTGCTGTTCTTT
TCAAGGACGCCATGTCCAAGTCTTTACTCAACCAGGCTCGTCCCGAGATCCGTGACCTGTACAACATACT
CGAAGTTGATTTCCATCCCCTTTCAATTTGCAAGAAGATCTCGCCCATTCTTGCCCAGATTGGTGCCGAT
GAGGATATGAAGAAGTACGTGCTGCCTCTGCAGCAGGTCATTCTTACTAGGCTCTTCCAGCAGCTTTCTC
AGGTCTACGAGACTGTAGATCTTGAGTTCGTCGAGAGCCTGGCCCAGTTCCCCGAGCCGTTCCAGGTGAC
TCGCGCAACTGTGGAAAAGTTCATCATGAACGGCAACAAGAAGGGAGATCTTTCAATCCGTATGGACCAT
GGTACAGGAGTTCTGAGCTTCGACACGGATATCTTCTCATCCTCCAAGGCGTCTCACTCAGGCTCTGCGG
CTGGTTCGGCAGAGGCCGAGGGCGGTTCCGTTCAGAGACTCCAGAGGACTCCCTCTGAGATTGTTAGGTC
ACAGCTTGTTCGCCTTGGCCGGGCCTTGTATACGACATGCTACTACGTCGATCCCTCATTTAACGAGTCT
CGTGTTAAGGCCCGCGAGGCTGCATTGGCGCGGGCCAAGGCCGGTGCTGAGAAGGAACACCGTGAGATCC
TGGCACGAAAGGATATTATCCAGAAGCGCAAAGAGGAGGCTTCGGACCTGCAGGCCAAACGCGAGAAGGA
GAACGCTAAGATCAAGCGGATGCGTGAGCAAGCACTCCTGGAGGCGGAGCAGCAACGCCTGGCGGAGGAG
CAGAAGGAGCGTGAACGCAAGCGCAAGGAGAAGGAGATGCAGGAGATCCGCAAGCAGGAGGCAGAGAGTC
TCATCAAGGATCTCAAGATTGGTCCCAATGCTCTGGATGTCAGCGCCGAAGACTTGGCAAATCTCGACAC
CTCGCAGATTCGCGCCATCAAGGTTGCCCAGCTTGAGCGAGAGAAGAATGATATCAACGAGAAGCTTCGT
ATTACTGGCAAGCGTCTGGACCACCTCGAACGTGCGTACCGCAAGGAAGAGGTTAAGAAGCTTCACGAGG
ATTACGAGAGCCAGAAGAAGCGTGATCTGGATGCCTACAGCAAGATAAAGGAAGAGACTTTGAAGGAGTC
CAAGATCAAGCACGAGGAGAGTGTGGAGCTGAAGCACCGTCTCAGCCGTCTGATGCCTTTCTACGAAGAA
TTCCGCGCCAACCTGCAGGAGAGGCGTCGGGACGAGTTCGAGAAGCGCCGCCGTGACGCCGAAAGGGAGC
TCGAGAAGCAGATTGCTCAACGCAAGAAGGAGTACCGCGAGAAGAAGTTGCGCGAGAAGAGGCAGCGGGA
GGAGGAGGAGCGACAGCTCCGGGAAGCCGAGGAGCGTGCTGCAAAGGAGAAGGAGGAGCAGAAGAGGCGC
GAGGAGGCTCGCAAGGAGGAGCTTGCACGTGCCAAGGCTCAACGCGAGGCCGAGAGGCAAGAGATGGCCG
AGAAGGCTGCTCTGCAAGCCCGCAGAGAAGAGGAAGCCCTCGAGAGGAGAAAGAGGGAAAAGGAGAAGTT
GGCCTCGGCGCCCCCGGCATCGGCCGCGCCTGTCAGGGCCTCGGAGTCTGCTGGCGGCCCGCCTCGCCTC
AACTTGGCTGGTGCAGGTGGCAAGCCCAGCTGGCGTGACAGGGTCCCATCTTCAAACGTCGGAGCCGCTC
CCTCGGAGCGTTCTGAGCGTCCCTCGGAGCGCCCTGCTCCTGCCCGAACTGGTACCCCCATGGAGCGCAC
TGATTCAAACGATCGTGCTGGTGGTCCGCCCCGGCTTAACCTTGCTCGTGCTGACGGTGCCAAGCCCAGC
TGGCGTGAACGTGAGCAGGCCAAGGCTAGCGGTGGCCCTGAGCGGGATCTTCCTCCCAGCAGGGCGGCTT
CTGGAAGGGGCCCACCGATGCACAGGACCGATTCGGGCCGTGGAGAGAACGGCAGGGACGAGTCGCCGGC
GCCCCCCAGAGATTCATTGACGGCTTCTGGAGCACCAGGCAAGTACGTGCCGCGGTGGAAGCGTGAGAAT
GCCGGGAACTAGGTTCTCGTCAAGGACAAAAAGCAAGCAAATAGTTCACTTTTTCCTCGTTAATTTGCAT
TGGGAGTTTTTGGTCTTTTGGTCGATTTGGTCACGATAGTCGAGCTGGTCTGTATTCTAGAATCAACCCG
TCTGGCTCGCTTTAAGCTGGGAGTGGGGAAGTTTTGCGAGTCTCGGGAGCCTAGAACGGAGCAGTGGGTA
GACGGATACTGGGGGTGGATATAGGTCATGTTTGGCACCGTGTTCAGGTTTCGGTCCGTCACCATGCGCA
ATGACAAAATTCATTCACGTTATTTCTGCTTTCTGTCCTTTTTTGTGTTGGGGCGGTTCGCATCTGGGAT
GCCAACCTTGAACCGCAACGACGATGAGTTTTATTTACTTTCGACAGGACCACAGTCATGTTTGTTGTCG
GCAACATGTGTGAGAAAAAAAGAAAGAAAGGAAAAAAAAAGCCATTATCATCACATTGGTGCCCGCCCCC
CTGTATGTGTGCTAGGTGTAGC

FIG. 3H

SEQ ID NO 39 (underlined sequence); SEQ ID NO 60 (complete sequence)
<MG00604.4;DNA;Magnaporthe grisea>
GCTCACCGTTGATATTGGCAAGGGTCTGGACCATTAGCTAATGATGTGGTGTCCAATCACACGAGACGTC
TGCAGAGATGATAGCTTGTCGCCCCTGCGCGCTTGTCCGACCAGCAGCCGGGTGATTGGTCCGTTGCAGC
TAGCACAGACCAAGCATCCCATGTAAACAAGGGTCTACGCGTGGGAAGGTACAGTTACGCTTCTTGGATG
GGGCCTGCTGGGGACGGTTCGGTTGGCTCGTTGGCTCTGTCTGCTCTGGGGGGCAGGCGGCGGTGAACAA
TTTCCCACAGCTGAAAATCAACAAATCCAATCAATCCCGACCCCATTTTTCGTGTCCCCTTTATCCTCCC
TCTCCACTAAAAGAAAACCCACCACTGCTAGGAAGCAACCTCTCCTTCACAAACACACACCACCTTTGCA
AGCATCTCTCAACTTACTCTCGTACTCTCTCGACCGCCTCGCTCCCATCAACATCAGAATCCGACTTGCA
AACCATAAAAATGCGTGAAATTGTTCACCTTCAGACCGGCCAATGCGGCAACCAAATTGGTGCTGCTTTC
TGGCAAACTATCTCTAGCGAGCACGGGCTCGACAGCAATGGAGTTTACAACGGCACCTCCGAGCTCCAGC
TGGAGCGTATGAGCGTCTACTTCAACGAGGCCTCCGGCAACAAGCATGTTCCCCGTGCTGTCCTCGTCGA
TCTCGAGCCCGGCACCATGGACGCCGTCCGTGCCGGTCCTTTTGGCCAGCTCTTCCGCCCCGACAACTTC
GTCTTCGGTCAGTCTGGTGCTGGAAACAACTGGGCCAAGGGTCACTACACTGAGGGTGCCGAGCTTGTCG
ACCAGGTCCTTGACGTCGTCCGTCGTGAGGCTGAGGGCTGTGACTGCCTCCAGGGTTTCCAGATCACCCA
CTCCCTGGGTGGTGGTACCGGTGCCGGTATGGGTACTCTGCTGATCTCCAAGATCCGCGAGGAGTTCCCC
GACCGTATGATGGCCACCTTCTCGGTCGTTCCCTCGCCCAAGGTTTCCGACACCGTCGTTGAGCCCTACA
ACGCTACCCTCTCGGTCCACCAGCTGGTCGAGAACTCTGACGAGACCTTCTGCATTGACAACGAGGCTCT
GTACGACATCTGCATGCGCACCCTGAAGCTGTCGAACCCCTCATACGGTGACCTGAACTACCTGGTTTCG
GCCGTCATGTCTGGCGTCACCACCTGCTTGCGTTTCCCCGGCCAGCTCAACTCTGATCTCCGCAAGCTTG
CCGTCAACATGGTTCCCTTCCCTCGTCTGCACTTCTTCATGGTTGGCTTCGCTCCTTTGACCAGCCGTGG
TGCCCACTCTTTCCGCGCTGTCACCGTTCCCGAGTTGACCCAGCAGATGTTCGACCCCAAGAACATGATG
GCTGCTTCTGACTTCAGGAATGGTCGTTACCTGACCTGCTCTGCCATCTTCCGTGGAAAGGTTTCCATGA
AGGAGGTCGAGGACCAGATGCGCAACGTCCAGAACAAGAACTCGTCGTACTTCGTCGAGTGGATCCCCAA
CAACATCCAGACCGCTCTCTGCTCTATCCCGCCCCGCGGCCTCAAGATGTCGTCGACTTTCATCGGAAAC
TCGACCGCCATCCAGGAGCTGTTCAAGCGTGTCGGTGAGCAGTTCACTGCCATGTTCAGGCGCAAGGCTT
TCTTGCATTGGTACACTGGTGAGGGTATGGACGAGATGGAGTTCACTGAGGCCGAGTCCAACATGAACGA
TCTTGTTTCCGAGTACCAGCAGTACCAGGATGCTGGTGTTGACGAGGAGGAAGAGGAGTACGAGGAGGAG
GCCCCTCTTGAGGGCGAGGAGTAGGATCAAAACACTCTTACCCCGGATGCTTCCCAATTGGTCGCTTACG
ATCAAAAGTCGGCACCTTTGTCTCCTTGCTCCAGGATAACATCGCTCGCGGACTCGCTGTCTGTGCTCGA
GCTGGAGGGCTGACGTAGAGGCTGTTGTTTTGATTGTGCTGACATGTTGGAGACTGTTGTCGTAATTTGA
TACCTCTCCCAGAGACAATGGAGCAAAAAGATACAATGTTCATTGGACTTGAATGCCCTTGCCTTTAGCT
GATGCGGCGAGCCGTTTTTACAACCTATGTTTTAATTACAAAGATGAATCAGATATTCCATTCACTAAGG
GCACATGTCAAGCATTGTTAACAACACGCGCCTGCCGGATCCATCATTCATGGTCATTCCTATGTTGACC
TGTGGATGACCACATAGATTCCAAGTGTTGAGTAAGCAACTTGTCGGTTGCTTAGCCTTGTGCGTACAAG
TGGTAACATCAAGGTAGAGAATCATCTGCAAGGG

SEQ ID NO 29 (underlined sequence); SEQ ID NO 55 (complete sequence)
<MG05169.4;DNA;Magnaporthe grisea>
GCCGCCCTGGATTTTGAGTCACTATCGCTGCGGCAGGTGCTTACATCCCGCACGCTGATGCTGAAAACAT
GTCCAAACCACGTACTATTAGCTAGTTCTAGTTCTATCTAGTAGAAACAAATTATTTAGCAGCCTCTTGC
CGCCATACCGCGGCGACAAAGTCAATGTCGCAAAGGCTGTTGTTTGCTGTTAAATGCAGCCCAAGGCCCG
CATGTCGTTGTCCCTGCGCCGTCGATCTATTTTTTTATTTTCCTCCATCGCGTCCAATCAACTCGTCACT
GACAACAGTGGCCAGTCAAAACAAGAGCCAGCGACTCGATCAAATTATTCTGTCTACTGCCGTTGCAGAC
ATCATCCACGGCCCCACCCAAACCCGCAGCCGCAGCACTTGTTGCCCCTCCACTACGACTAGTTTTGGTA
ACCGTAAAGAGCTACTATCACTACCACGCAAACGGACCAACACCCCTAGTTCTGCGCGTCACTTCTCGTC
AAAGTCAAGCATGGCCACCGATGCCCAAGGGCCTGGCTCCCTCGGGAACAAGGCAGCCGCCTCAGATGGC
ATGCCAAATATGGTGATGCCATATGAACCTCAGGACCCCGCTGTCATCGCAGAGATGGTCCGCGTGCTCG
ATGAGCATACAAAGGCTGGCGCCAAGGGTCGTTTCCGTATCAAGAAGACCAAGTTTGCCGTTACTGGTTC
TCCTTCCAAGGTCACTGTAGATTCCTGGAAGCTACAGGACTGGGACTACAAGAAACCTGGGCTGCCTACA
TATGCCCGTGGCCTCTTCACCACGCGCCTCCCAAATAATGTACCAGAAATTGCCGTCAGAGGTTATGACA
AGTTCTTCAACGTCGGCGAGGTGCCGGAAACGAACTGGGAAAATATCATCAAGAACAGCAAGGGTCCTTA
CGAGCTCAGTCTGAAGGAAAACGGCTGCATCATTTTCATCTCAGGCCTTCACGATGACACCCTGTTGGTA
TGCTCAAAGCATTCCACTGGTGCACGCGGTGATATTGAAATCAGCCACGCCAACGCCGGTGAAAAGGCTC
TCGACAAGCAGCTGGCCAAGATTGGCAAGACTAGGGCGGACCTTGCGCGGGAGCTGAGGGAGCGCAATGC

FIG. 3I

CACCGCTATCGCCGAACTTTGCGACGACAGCTTTGAGGAGCACATCTTGGCTTATGCCCCCGATAAAGCC
GGCTTGTATCTTCACGGCATCAACGTGAACCAGCCCTACTTCATGACATATCCAGGCCCCGCAGTCAACT
CGTTTGCCGACGACTGGGGCTTCAAACAGACCGGGTTGCTCATAATGGACAACATTAAAGAGGTCAAAAC
GTTCTTAGAAGACGTAGCAGAAACTGGAGCCTACGGCGGCCGAGACGTCGAGGGCTTTGTTATCCGCTGC
AAGCTGAAGGACCGGCCTAATACCGACCCTGGAACATACTCGGATTGGTTCTTCAAGTACAAGTTTGAAG
AGCCTTATCTTATGTACAGGCAGTGGCGAGAGTGTACCAAGGCTCTCATTGCCGGCCACGCCCCCAAGAT
CAGGAAACACAAGAAAATCACAGAGGAGTACCTGTACTACGCAAAGACACGCCTGGCAGAGGACTCCAGC
CTCGCAAAGGCCTATAACCAAAACCACGGCATCATTGCCCTTCGTGACGATTTTCTGAAATACAAGAACA
TGAAGGGTTCCGATGCTGCCAATCTCGATCGGGATGTCGCCACTAACGAGCCGGAGCCAGACAACTCGGT
CGTTGGCAACGTGATCCTCGTTCCGATTGCCACCATTGGATGTGGAAAGACAACAATTGCCGTCGCCTTG
AGGACCCTCTTCCCTGAAGCGTTCGGCCATTTCCAAAACGACAGCATAACACAGAAAAAGGGAAGGCCGG
CTATATTTACCAGGAATGTGCTGGAACAACTAAAGACAAAGAGGGTTGTCATCGCGGACCGCAACAACGC
ATGGCGTCGTGAGAGGACACAAATCCTGGGCGACGTCAAGAATATGCTGCCCGCAGCGAAGCTGGTGGCG
CTTCATTTCGACCACGACAACAGCATGGAAGTCCGCAAGCTGACATACGAGCGCGTTTTCCAGCGTGGCG
ACAACCACCAGAACATCAAGGTGCAGGAGCTCGGCAAAGCAAAGGTCATGGACATCATGAACGGCTTCCT
GGATGGATTGGAGCCATACAGCGCCTTCAGCAAACCCGATGCAGACTTTTCTGCTGCCATCGGTCTAAAC
CCTCTCGCCGGCAGTCGGACGAATCTGGAGGTAGTGATTTCCAAATTACACCAGTTTTACCCAAACCTTC
TCCCTCGCGTCCCCACGGGAGAGGAGATGGACAAAGCGATCGATACTGCACTCGCATATGATCCCAAGTT
AGAGCAGCTGGCAGTTCTGCCCGCAGCTGCTAACAACAACAAGGGTGGTATTGAGTACATGTCAATTGAT
ATCCCGTCGCAGGCCGTCCTGGCCGCCCTCGAGGATGCCTTCAAGGATGCCTCCCCCGAGGTAGGCCGCA
TGTATGGATACCTGAAGCAGCAGCGCCGGATCCAGCCGGCTTTCCATGTAACGCTGATGCATAAATCCGG
AGCAAAGACCAGCCCAGAGAACCAAGAGCTTTGGACAAGGTATACTCAGACCTTGAAGGTGGCTCACGAT
GATGCCAAGTCAAAGGGCATCGTATTCAGGGCTGCGGAAACCCCCAGCCTGGGTGAATGCGACGTCCAAC
TTGAGCGCGTGGTCTTTGACGACAGGCTCATGGCGATTGTGGTGCGCATAATCGACAAAGACGACAAGTG
GAAGTGTATAAACAGGGTTCCGCACATCACGATCGGTACTCTGGACAACACGGTGCCTCCCAAGGAGAGC
AACGATATGCTGGCTCTTTGGATCGACGGACAGCAGGAGGCTCGCCGCGGTACAATCCGCGAGACTGGCA
TTGAGGGCCGTCCAATCGTCAAGGGCATAGTCAAGGCGGTCCTGTCAAAATTCTGATAGCCCCAGTACGG
CAAGAGGACTCGTCATGGACCAAAGGATGACGGCCAAGGATTTGTGTGGTTTTCGTTTTGCGCTGACACA
TTACCTCGATTTCGTAGGTGGCGTTCTATAGGGGCAATAGCGCTTGAGTCTAGACGTGATTCAACCGGTC
ATTCGAGTTATGGATTCAGCTGCCCAGCATGTATTGGTTAGCAGCATCCCGCGGGTGAAATAAAAGCGCA
TGTTTTTTTTTCGGTATCTGGTCATGGGCGCGAAAACAAATAGTCTTCTTTCTACCTTGGAAGACCATTT
AGATACACAGCAGATATCTGATCATCACACTTTTTATTCCACTCATTACAGTGCCTTTTTTGTCCCCCTT
AAAAGAGGTTCCATGGGTATATCACATTTAAAATGGCCAAGGAAATTCTACTGCTTTGCGGGTAGGGAAT
CCAGTTTCAACGGCTTATGCTGTTAGTCACCTTGACAAATGCCTGCCACTGCCTCCAGGCCTCACC

SEQ ID NO 23 (underlined sequence); SEQ ID NO 52 (complete sequence)
<MG04056.4;DNA;Magnaporthe grisea>
GTTGTGGAGGGGCCCGGGTTTTGTACCGGGTTTCAATGCAGGGTAGGTTAGAAACGGTGATGATGTGGGG
AGGGGCGCCCGAGTAGATGTTAGTGCTACTGTGTACTTCACACAGTACTGACATGCCCATCGTCGCGGAA
CTAGTCGCATGCACGCAATTCATATCTTCCAGGCGTTTGTCTGTCTCGGCAATTTGATCCTAGAGACCAA
CAAGGTCTTTTTAGCTGATCGCGCAGTTATTCTTTTAAACTCGCAGTCAATTGTGTGCCCATGCTGACAA
GCACCTCGCTGTCGCATCGGTGATTGTCAAGCTTACTGTAGCTCCAAGTTCCAGGACAAGTACACCGCCG
AGGACACGACTAAAGACGGGCCCCGAAGCTTATCTGGTAGCTTTGCGTGTCTTGAGCTGCAGACATATGA
TGCGACGGCCCGCTACGTACCTGCCTATAAAAGTCGACCGCGCTCATTAGAGACAAAGAAGGAATGACAG
CTCCCCGAGGATGAGCGCGGATCCTCTGTTACCCATCGCTCCGGCGAGGGTAAAGGCCCTGGTCCTCCCC
GTCGGCCAAATCAGACGCCAGCGCTTCGCCTCCTTTCTGGATAGGCTGGCCGCCGAACAGGTGGTTCAGC
TGCGCGACATCAGCCCAGATGGCCGGCCGAACAGGAACATGTTCTCGCCCCTGGCGTTCCCCGACGGTGC
CATGTTCTACGAGCTCACGACCCACTACCCGCACCCCTCCTACTTGACCCTCACGCCTTTCGACCTCTAC
CGCGAGCCCTTTGTCGTCATTGCTGTTGCTGACGCTTCCGAGATCGACCGCCATGCCCTCAGCAAGAGGC
AGTCAGGAGGGGGTCGGACCACCACTGAAAGAAACATTAGGGGCTTGTACCAGGACCTGGAGGACCTACG
CGACCAGTTCCCAAAGGTACTCGTGCACAGGCTGTTGCTTTTTGACTACGTGGAGAATCCCGACGAACAC
GTTCCGATCCCAGAAGACATCACGACCATACCGCCACCCCAGGACTGCAAGAGAACAACCATGAGGACGG
TCATGTGTGACATAGCGTCACAGCTCCTGGCCGAGATGACCTCAATGGCAAAGCAATTCGAGGCACTCTC
TTATGTTGATTCCCCAGGCCAGATACCCACAGGACAGCCGAATGGCCAGGACCCTATGCACGCCAGACGG
AACTCGCAGTTCTCGTTGCCTGGGGGGACCAACGGTGGACGTTCGAGCTCAGCTGCCGCAAACAACCGCA

FIG. 3J

TGTCTATGCCTGTGCTACCAAAAGGTTCAGGCTTTGGATCCGCCGGTTCGACGCCGATCAGGCCATCTAC
GCCGGTAAAGAGCGGGCTCTCAAATACGCCGAATCTGGACGATGGCTCATCAGAGTTTAGCTCGGGCCCT
CCGACGCCGGAGCAACCCAATGCAGTACGGCCTGGTACCAATGAGAACTTTAGGACAGTCAGTCAGGACA
GGATATCAGTGCAAGGGTTTGGGTCCGGCGGGCTCAACGAGAGGTGGAGAAGCAAAGGCAAAGGCAGGGT
GACCATCATCCTGGGGTCGTTATACCTGCAGGCGGGGCGATGGCCAGATGCTCTGAACCACCTCACCGAG
GGCGCTACCGTGGCCAGGTCGATTAACGATCACGTTTGGCACGGCAAGGCTCTGGAGCTGATCGTGATAT
GCTTACTGCTACTGGGCTGGGCTGGTGTTGAGTTTCAGGTGCCCTCGGTGCTATTGGCGCCGACCTCGGA
AAAGACTTCTGCCAGCGCAGCAGCGGCCATGGCCGCAGATGAGAAGAACGCAAGTCCAACCCAGCCGCGG
TGGTTTAGAAACTTGCAGGTCATCCTGCCTGACCTGCTAGACCGCATAATTGCTCTATATTCAAGGATAT
CAGCTGAGCATCTACCCCCCTTGCCAATGGCCGAGGCTATCATCAGATGCTCCAGGACCTTGACTGGGCT
TCACCTGACTGATGGCTGTCTCGAAGCCGACACACTTGGGCTCTTGGTTCTGGGGCGGGCGCCGACCAAA
GTCTTGAGCTCATCACCTCGGCTGACCGTGACTCCGTCCCGTACACTCATCGTCAACATGATGTTCAAGG
CATTCCCAAACTCATCAACCGAGATGCTGAGCGCGGTCGATCGAATCGCGATTTTATCAGGCATCGCATC
TGTCCTTGGCATGCTAGGCTATCAGAGGAAAAAGGCCATGGTCATCCGGGAGCTTGTCTCAGTATTGATA
GGGGGCCTCGTTGAAGCTAGGACGCGTGGTGCGGCTGAGGTCGGCATTCACCCTGCTGCAGGGCTCGCTG
CATTGAATGGCGTCAGCGGCCACACGACAGGAGCTGCAGCCCTGGACCTTGGAGAGGGCGACATTGAAGA
ATCGATCGACGTTTTTCTAGGTCTCTTGCTCAGAACATATGGCGTGGTCTCATTCGAAATGGATACACTC
GTATCACCAACCAAAGATATGGAAACTGCTCATACTGACGACGGCGCAGTCGTTAGGATACAAAAACAGG
CAGCGGCAAGATTCTTTGGTATACCTGCGCTCAAGCTCAATATCCTCAGAGCCTGCATAAACTTCTCTGA
GGCACTGCCAGACTTTAACGGGGTGCTGAAGTATTCGAGTGATCTGCTGCGGACTGCAGGCAGCGGTCTT
GCACCTGGGCCGCGGCGTGAGGATGCCGCGCCCATAATATCTAGGGATGAACAGGTGCGCCTCATAACCA
ACATACTGAAAACATCTAGCCTCTCCCAGCGTCTTGGCATGGGTGAAATGCTGGCCGATTTTTGGGACGA
ATTCTTCCTTAGGGGTGTCAAGCTCGAGCCTCTGCCCCGGACGCGGGCAACGATTGAGCATAAAAAGAGT
GAGCTTGCAGGTGCATCGACGGCGCGCGAATCCCAGGACGTTGATCCTCTAATTCACAACCCGTTCCTGA
AGCCGCCCGACAAGGCAGCAGTAGAAAGTACCCTGGTTGCGTTCGAGCCCGCGACTTTCAAATTGACTTT
ACAAAATCCGTATGAAATCGAGGTTGAAATTGAAAGCGTGCGGTTAGACACGGAAGGGGTCGAGTTTGAA
TCCTCTGTCGACAGCGCCCTCATTGGCCCATATCGCACGCAGATACTTCGTCTAGTCGGCATACCGAAGG
CTGCGGGGTCTCTAAAGATTACCGGCGCCATCATCAAAGTCAGGGGTTGCCGAGAGAGGAGGTTTCCTAT
ATTCCCGAGCCCTTGGTCCCCAGAAGACCAACCAAAAGTCAAAGCTATTGGGCTGGCAGCTTTGGAACAG
CATGTTTTGGAGCCGGCATCCCAAGCCCCCAAGACTGACCACATCTCGCTCAACGTCATAGATGAGCAGC
CAGTTGTGGTTGTCAAGTCGACTTCGTTGGCCCAGTCTTCGGTTATGATCCTAGAGGGTGAAAGTCAAGT
ATTCTCAGTCACACTGCAGAACCTGTCCAAGACAACCGCGGCGGACTTTTTGTTGTTTTCGTTCCAGGAT
TCGACGCAGGAGCCTTTGCAAGCTGCATTAAGCAAGAGGAATGCCACCCCTCAGGAGCTATACGAGTACG
AGCTGATATTGGCGCGAAAGCAAGCTTTGCGTCTCAAGCCCAGAGCGGACCACAAGAGGTATATTGGTCC
CGGAGAAGAGGCGACGTTTGATTTCCAGATCCTGGGCAAACCGGGGCTTACCGGCGGTATTATACAAGTG
GATTATGCGCACCTTGGTGTACCACCGGAGGATGTACCTGCCAAGTTTCACACGCGCCAGGTGGCCTTGC
AGCTTACCATTACGGTCAACGCGAGTGTCGAGTTGACGAGGGTTGACGTACTGCCTCTTCACGAAGGTAT
CCCTCGGCCACTGCTTGAGACGGCCTTCCGCCGTGGAGATGGTGCCAGTTCCCTAAAGGAAATTCAAGAG
AAAGTCTCGTCAGACGATTATTGCCTGCTATTACTTGATCTGAGAAATGCATGGCCCAGCTACATGCAAG
TCGAGCTGAGCACTGAGGACGGCGCTCTAATAGAAGAGACGATATTGCCAGGGTACACGTCGCGGGTCAT
GGTATTACTCAAGCGGGTTTACTTGGAAGATCCACATGCAGCAGTCCCAACCTTGAACCCAGCACGGCAG
CGTCAATTTGTTGTAAGCACGACAATATCACCAGAAACGGAAAGAGCCAACCGAGAGGCGTTCTGGTACA
GAGAGGAGTTGCTCAACCGGATCAAGGGGTCATGGCGGGCGACTTCTGGTACCAATAGGCACGGCGCCAT
CGAATTGCGCAGCATACGGCTGAGCCCGCGTATGATCGACGCGGTCAAGATTGAGGACGTTGACATTGAC
ATCTCAGTTGCGTCGCAAAATCCCGGCGACGATGAGAGCAAGAACGTCTTGTATGTTGACGAATTCTCGC
GCCTCAACGTGCACATCATCAACCGGTCCGCGAAGCCCATTTACCCGACGCTGCGGCTCATGCCGGCCCT
CTGCCACCGACCGCTCAACGTGGCGCTGGACTACACGAGAAAGTTTGGTTGGATCGGGACACTGCAGAAG
TCGCTGCCGCTATTAGAGGCGCACGGGGAGACGAACGTCGTCATGACCGTGGCCGCGCTCTGCAGAGGTC
AGTTTGAGGTCACGGCATCGGTGGAGGAGACGCAACTCTGGCGGGACGAGGGAGCGACGGCCAAGGGCAG
CGATGAAGGCGGCAGACCAAGATCAGATACGCAGACGCTGATGGACGCGGTTTTGGGGGCCAGAGAGAGG
AGGATCTGGCACACTCGAAAGCCCTTCACTGTGACAGCTCTGGATAGAGACGGATGAAAGGAAAAACGAG
CGACGATAGCTCTGCATTTTAGGGTATATATTGAAATAATTTATATAACAGCATTTACTGACAGGGGTTG
GCTATTGGAAACGAGCAAGAAAACAAAAGGGGAAGAACCGACTCAGAGTAAAGTCGAGGAATCCTTACGA
ATAACTGACGCGCTAGGGACTGGAGCTAAAAGTCAAAGGAAGAAAAAGTCAGCATGAGGCGAAAGATTCT
TTGCTTCAGGGCCGGGATAAACCCACCGAATCCGAGGGCCTGGCTAGACTACACTTGGACCTGACCGACT

FIG. 3K

TTTCCGAATTTATTTTTCGGTCCGTCTCCTCACTCGTGGTTACGGAGTACACATTCCTGTTCAATTCTTA
GCTCACATAGTTGGACATTGAACAAAGTTGCTTGAGCTGGTGTTGAGTCATTTTTTATTTCGACGTTTCC
GAGTTTGTCTCTTTCAAGGACCCGCTTTCCTGGTGGCGGAATCGGCCGAAGCATACCTTACCTAGCT

SEQ ID NO 21 (underlined sequence); SEQ ID NO 51 (complete sequence)
<MG08911.4;DNA;Magnaporthe grisea>
TCTCCAACTATCGTACAAAAAAAGTGAGACGAGATTCGGAGCCTTGCTTGCTCTGCAGATACCCCTGTTT
CCCACTACCAAACAGAATGAACAGGCAGGGCGGCTACATTAGGCGTGCTTTCCCCAAAAAGCTTTGCTGT
TGCTCAGGCGGCTTGCTATGGCTCCAAGCTTTACAGTAGGCCAGAAAGCCCGAGATACTTGAGGCGGGTA
CCTAAGTGGGGACAAGTGAAGCTTTTGATTTGCCGACACAATAAAAAACCCCACCCAAGCTACCTTGCCC
ATTCAACCCAAACCCAAATCTGAAGAAAGTCTTGTCGCGTCTGGACGGCGCGCGTTTTTGCAGAAGCTCT
CCGCACGACGACGTTTGTTGGACGATCCCCCCCAGAGCTTTCCAGAGCGCGCGCAAACCGGAGGCCAGGA
CTCAGCTCATATGCACTGGGCTCTCGTCTGCGCATTTCAAACTCGCACGACAATGCGCCATTACTAAAAG
CCCGCCCACCATGTCCGAAGCCTATCTTTTAGAGACACTGCAGTCCTTCTATGGCGATCTAATCGCAATA
GGCGAGGGGCGCCTCAATGGCCCGTCTCTGGAGGGAGACGAGCTGACGGCTCTCCTCGAAAACTTCAAGA
ACTTTCTTGAGGAGCCACCAAAGCGAGACGCTAGCCGAAAACAACTTGAGTCCGGCAAGATTAGCGTGGG
AGACGTAGAATACTCGATCAACAAGGAGTTCCAGGAATATAGCATACAACTCGCAGACGAGGTAAACCTG
GATGAGGTCGAGGCGGCCAAGCTGCTCCTCGAGGCACAAGATAGCCAGATCCTCCTGGGAAGGTCGCTAG
TCGAGTGCGCGCTCATTCGGTTCCACCAACGACGAAAATACCTCCTAGATTGTATACGACTATGTATCGA
GCTTGCGAATGACGACGAGAACGAATCGATCAAGGCGGTCTTCGAAGAAATTGTTGCACGATATGTTTTT
GACCTGCCATTGCCAGGTGCTCCGGCCGCGGCGGTTCCGAAGGAAAAGAAAGTAGTGCCACGGTGTATGG
CAGCAATGGCCAAGATCAAAGACTGGCTCGAAAAACTGGCCAACAAGATCATGCTGGCAAGAATGCACAG
CGGCACGGCTCCTCCTGAGATCGAGACCATCGAGTTTTGCCGCTTGAGTCTAGTGCAGCAACACGAGAAC
TTGGCCGTCATCCTATGCGCTGCGGTTGAGCAACGTCATGCAGAACGCACAAACTTTGAAGAGTTCATCC
AACTGCTGAAGAAGGCCGATAAATACGACCACCTCTTAGTGCATCTTTTCCCCGTCATTGGAGCCTATAT
TCGTCTGTATGGATCGACTGAGGGCTGGGGGGATCTGGTTATTGCCAGGTCTTTGAACCAAAAAATTGTC
AACGACGAGACGTCTTGGTCCTTGCCGTTTCTGTATGCCGCTGTTAAGGTCTGGTGGATTGCAGAGTACA
GCGGCTTCTACGTCGAGGGTCCTGTTTCGGATCCCAGCATTGACATTGACAAAGAGGATAAGGAGAGAAA
TAAGCAGTTCACCGACGCTCTCAAGGAGGGAGCATTCGACTTCATGTTGTCACTTGCAGGGGATGTTGCT
GCCCCTGAATGGCAAGACCCCTCTCGTATTGGAATCAGGCAATGGCTCCAGCGAAAGTCACCACAACTGA
TGACTGATTCAACGCCATTCTCCGACTACTTCCACACGTGCTTGATGAACCAGCTTGAAGATTTTGTGGA
TGCTTTTATATCAAATCTTCCCGATGTTCTTCGGAAACTTAGGACCGAGGAGGACGAACAACGGCAGCTT
AGCCAGCACCATGAACAAGACTTGGATCTGGAAAGATTCCTGGTCATCATCTCTTACGTCTTTGAAAGAC
GGCCCGACGCAGCTGACGTGTTCTGGTCGGACTCTGAAAGCAACTTGGCAGGTTTCATGCAGTGGGCATC
CAGGAGAGCATCCACGCCGCTCGTGTGTGCTTTCTGCGAGATGCTGCAGTCCATCACTGAGAATGAACAG
TACGCACTTGCTGCTCACCAGTTCTTGTTGGAGGACAGCAATGCCGGAGGGAAAATGAGAAGATCACAGT
CCTTGACATGGGCTCAGATTTTCAAAGAGTTGCACTACTTCACCAAGAAAATTCGTGGTGAAATCTCTAG
CCCACAGCAAATTCACGAATACCGAACGCAAAAGCCAGGCGAGGACCTAGCAGAAACGGAACCGGAGTCG
GCTATGCTGCTGGAGTGCTATCTCCGATTGATCGCCCGACTTGGAAGTCAGAGCACAGCGGCAAGGGAGT
TCCTACTCAGGAACCAAGACTTCCCCTTGGTAGATGTGATTCTGCAGCTGAACAGCTGCCACATACCTCC
TAGGCTGCGTGCCTGTGGCTTCTATGCCATTGCGGCACTAGTCAGGCGCAAAGAACAAGACGACAGCAAT
ACCATGTGGCTTTGCATAGACGCCTTTGTTAGTGGCGGCTTTCAAGCCGCGAGCAACTCCCGTGGATTGA
TTAAGGGACAAAGCCACAGCTCAGCCGGCGTTGTTGATAGGGTATTGGACGAGCTGAGCAACGGTTTCGA
GGAACCAAGTGCTTTTATCAACCTGATCAACGCTTTAGTCGCGCCAGCAGATCAAGCAAGTCTCCTGCGA
GATGCCCTTCCTTTCCCCGAGAACCTTGGGTCTAGCTTACGAATGCCGGGGATTGAGCCATACGTTGACT
TTGTTGTGGGACATGTCTTCAGCCTCAAGTCAAAAGAGCTCCAGGATGTTTCGCAGCTGAGAGTTCTGCG
AGTGAGCTGTTTGGAGTTTATCTTGCTGTGCCTAAACACGTTCAACGAAGATCTTATCATTCTTGGTAAT
CAGACCAATGTCTCTGTGGACTTGATCATTGCCACATCAGACCTGGCCACATATGTCCGCCTTCACCCAT
TCGCTCGGGTGATGGAATGGATGTTCAACGGCCAGGTTGTAGATGCCATATTTGAAACGATACACCAACA
GTCCAGCGATATCGGAAGCGTTTCGCCCGATTCGCCCTTGATATTGGGCATTATACGAGCTGTTGAGGTG
GTGTCGAAAGTTTTGGAGCTTCAGGACACATATGTTGATCTTGTGCGGCAAGTCATAAAACAGCACACAG
GACAACGCCATAGACATGTGCCTCACGCTTCCTACGCCTCCTTCGAAGAAGGGTTTGCTCATCACCTCGA
GGTCGTCGCAGATCTCGGCCGATATTGCGGCCTCGGTCACCCAGAGCTGACCATGGTCTGCTTAAAGCTT
CTGGCACGGATTTCCACTTCATCGAAACTGATATCGGCGTGGAACACCGAGCCAGGTAGACAGTCCCACC
GCAACAAGGCGGTAGTGGCTCTAGAAAAAGATGGGGAAGCGGATTCTATTTCCGGATCCCTCATTGCCGA

FIG. 3L

GCTTATCGTGCCCCTTGACCTGGCTCGAGAGGCTGACTCTCCAAACTACCTAATCAAGACTTACATTCTA
GACTTCCTCTACGCATGTTTACGAGCATCTCCAGACCAACCAACTATCGCCCATCTTCTACTCGGCTTCA
AGTGCGGCGTGAGCCATTTGAAAGTCGAGCCCAGAGGCCAGTTCGAGGAAAGGACGTCGCTATTTCACAA
TCTTCTCAGGGTATTGCTGGAGACTCCTTTTGGAGACGAGGAGCTAGGAATGAGGACATGGCTTGTGGCA
TTAAAGCGCAAGTTATGGGGATACTGCAGATTCTTTGGAGTTCTCCTCTGTCCTCGGCCATTGTCTTGGA
AGAACTCCGGAGCAACGACGTTCTATTCCATATTCTGCTCCGCGAGGAGTCAATACAGCTGATCTGATGT
GGGATGGAGTGAGCATGGAGGAACGCGGATTCCTACTCTCTGACGCAGCCGTGGGTTTTTCGGAGTTCCT
GGCTACGAGGCAACTTACCTTCGATTATCTGGCCATCGAGTTATGCAGCGTCACCCAGAGGCGCCTCCCC
AGCTTGAAACGCCGTATCTATGACGCCCTTAACGGACAGGTCACTACTGCCAATTCGGACAGCCCTCAAT
CCATACCCACCATCTTCGATTTGTACGATTTTATGCCTGCGGACGGGCAATGGGAGATCCCTCTACCTGA
GTTCACCCATTTCAAAGGCGAAGAATTCAGTATGTGCCTGGAAGGAGCACATGACTCTGTGCTCATGTAC
AACATGGAGCGGGTAAAACAGGTGATTGCATTGAAGAGGAGGCAGGATGCTCAAAATGGTCAGATAGCTA
CGGCTGCCGACCTCGCTTCCGTGGACCGGGAGCAGGTTATTCTTGAGGAATACTTGGTCTACCACAACCG
CCAAGCAGCAGTCAGTTCTGAGCGACGGAAAGTGCTCAAAGCCTGGGTTAATCTGCTCATGGTGATGTTC
GAGGCGAGCGATCACCAGGGCTCAGCGAAGGTTGCTTTCCTTTTACAAGCATTGCAGACGATATTACCAA
CTCTTGAGTCTTTCGGATCCGAACGTCCGGGTGAGGCATTTGAGCTGGCGAAACTGGCAAAAGTTCTCCT
CTTCAAGCTCGACATAGCCGCTCCAGACGCAGAGGACAAGGACGCACATACCGTGGGCAACCTCATCAGC
GAGAAGCTCTTCCAGTTGTTTGAGGTTTGCCTGTACGCCATAGGTAGGCGAACGGGCAGTGCGGAACTTC
GATCCACGTACTATGCCATCTGCTACCGGTATCTGATAGGTATCATTGACGATGGAAGAGATTTCGTGCC
TGGCCGCAGGAAAGCGATCAAGGCTGTTCAGGTCTACGGCGAGCGCCTGTTGACCATCGTCTGCGACGAT
GCATTTGGCGGCGATGCAACGTGCCAAACTTCTGCGTTGATCTTGCTAGGCGCTTTGACGAACCTGGGTC
GACGAGAGGACGACGGTCAAGTGGTGGAGGCTCTCAATCGCCTGAACTTTATTGGCGTCCTCGTTGACTC
TTTGAAGACAATCCTCGATGATGTGACTGCGGCCCGTAAAGCAGGAAACTCGGACCAGCAAGAATCTTAC
TCGCACGCAAAATTGGCGCTTCTCCTTCAGCTCTGCCAAACCCGCGATGGAGCAAAGTATGTGCTGCAGG
CTAACCTCCTGCGCGCAATTGAGGTCTCTGGGCTTTTTGCGGCAGACCCAGAGCTCCAGATTGATCGGAG
CGACACTAAAGCCTTGGCGGACCATTATGACCTCCTAATAAGGGTGATGCGTGTCATCGGTGCGGCAATA
CTGAGTCGCGGCGCGCACAACGTCCCGCAAGGTCGCCGGTTCCTGACCGAGCACCGCATGCTTGTAATGC
ACGTCCTCAAGCGATCCGCTGGCATCGCAGCCGTCGACCAGAAGCTGGAGGCGCTAGTTGTTGGACTCGC
GGATTCCTTCATGGTGCTGATTACTGCCACAGAGTTTTTGGAGTTTGAGGATACTCAAGGGCGGGGTCCG
CAACAGCAAAAGAAGACTGGCCCAGTCCTGTTTCATTGAGCATGAGGCAGTCAGATGCCCGATGATAACG
ACTGGAGTAGAGGCAGCGTTGACATTTTGCGTAAAGCCGCGGTGGAAGAGGAATGTGTCCTTGGCGGACC
GTTGGAGTTGTCAGGGATTTGTATACACAGATAAAATAGACAATTAGCGTGCATGATAATGGGATCAGGT
GTACTCAAAAATTTCATCCAGGTTTACAAGCTCGAGTCCAGCGGGAATAACGTATTAGTCCCTCACTCAA
ATCATGCGTTGCGTACCGCATTTCACAACAAGGAGATCAAAACCTGCGCTAGAGGTTGTAAATGATTTCA
CGCCCAATGGTCTCAATGATTAGAGGGTGAGAATAATCGCTAAAAACACATAAACCACCAATGCTCCCTG
GGTATATCGTCTAATGCAACCGTTGCCGTATGGCTTCCCAATCGGGTTCTTCCGGGACCAGAGACCTCTG
ACAATGAGCCCCAACGCCTTGTTACAACACCCAATAGAGAAATGAAAAG

SEQ ID NO 25 (underlined sequence); SEQ ID NO 53 (complete sequence)
<MG06314.4;DNA;Magnaporthe grisea>
TCACTCCGGAACCTGCATAATCGCTAGCTCGGCTTGGCTTGCATTTCGCGCGTCAGATGGATCGGACTGT
GGCTTTCTTGCTAAGAGAGACTTGAATAATAATTCAAAAATTTAGGATTGCTTGCGGAGCAAATGGGAGA
AAAATATGCTCGCATGAGCAAAGTCTGAAGGGATTCCACAATCGAAACGAGGACTGGAGTTGTTGGCAGT
ATACAGAACAGACTGCCGCCCATCACGAGAGGGGAAAAAAAAAGACCAGTGACGATAATTGAGATTAAAA
GCCGTCAACAACCGCACCCTCTTTGTTTTATGATCAACACTGACCACTGTTGATCCCAATTGCCAAAGAA
AGACAAAACTCTTCATTCACTTTGCTTAGTATATCAATCCAAGCGATCACGGGTTCGGCAAAAAAACAGG
CATTTTTAACTATGCATTGAGTTTGAAAAGGCAACAGGCTCCAGAATACTGTTTCGCTTTGCCTTGATGC
CAAGTCCAATATGGATAACCCATATCCCGAAGAAGCGCTGCTTGACAACCACCAGCTCATACACCAAGAT
GAGCAGCTTGGTCAAACTGTTTTTACAAGAGAAGACTTTGAATATGCGCTGAGAGATTTTCAAGAGATGT
CTGGAGGAGAGGACGGGGGTGCCGTCTCTGAGGTATCAGATGCAGACTCAGTGTATCTCGGAGTCCAAGA
GCAGATCAACCGGGCCCAGGCAGACAGGACTGCGTTTCTTGACGCCTTCCAAAATCCCCAAGAAGACGAC
GACGAAGACATTTATGATGGCCTTCCAACAAAACCTCCCCCGCGTAAAAAGGTCAAGAGGGGACCCGTGG
TGAGGAAAGGACCACCAATCAAGAAAGCGCCTCGCAAGGCCAAAGAATTGCCCACCGAGATCAAGGTGCT
TGTCGATGCCGCGACCAATGCCTTCATAGCCAATCGATACGATGAGGCTCTACAGGCCGCAAGGGAAACT
ATCCGCCTCAATGCGGAAGTGGCTCCAGCCTGGGGCATCCTGGCTGCCGTGTATGAGGAGAGAGAAGACT

FIG. 3M

GGCGGCACGCGCTCGAGGCAAAACGTATCCAGGCCTCACTCACCAAGGGCGACACACAGCTTTGGCTTGG
TACTGCAGACTTGGCTTTGCACATGGTAGATGGCGCCTATCAGGATTCACCCGAGGAAATCGACAAGACT
TTGAAAGTAGCTATGGACTGCTACAGGAGCGTATTACAGATCGACAAGACAAACCCCGTTGCTCGCCTGG
GCAAAGCCGACATCCTCGCGGACTTGGGACAGTCCAGCAAGGCCGTTGCTGCTTATCTCGACTACCTCAA
ACAGAAACCTTATAATCTTCGTGTCGTTCGCAGCCTGGCCGAGCACGCGTACAATGCAAGACGGGCAAAG
GAGGCAATCGAAGCTACTGTACTGGCATACGAAGCTTGCATTCAGCATTTCAAATCGGGGCAGACCCTGG
ATGACGATCAAGTCCTCGACTGGATCGACGTCCGCATTTTCATAGAGCTCCTTGCTTCCCTGGAGAAGTA
CGATGAAGCCGCAAAATGGCTCAAGACTCTGGTGAGGTGGCTGGTAGGCCGCAACGACGACCTTCTCTGG
GACCAGTGCCAGGATGACCGTGAGTGGGACTTGGATGATACTCGAAGGTTGGAAATGGAAGGTTTCAATC
AAGGCGAGTTCCTGCCCCAAAGCTATGGCCATGGCCTGCCCCTCGAGCTCAGGGGCAAGCTTGCCGTCTA
TCGGTTTAGGACAGACATGGAAGACGAAGCAATGAGACATCTCAGGCAACTCGACCCGGAAGATGCAGAC
ATAAGGGGGAAGCTACAATTCACCCCTGAGATTGCCAAAGAGGTTGCAGATCAGCTGTGCGAAAGCGGGA
AGCCCGAGCGCGCCATTCTATACTATGACCTATATCGGGACCTGGTAGGCGAGGCATTGGATGCCGAATA
TTACGTCAAGCGAGCCAAGTGCCACGTGCAACTGGCAGATGGGCCAGCGGCCGAGGATTGCTTCATCTAC
GCGCTTGAAGTAGACGAAGATAACATCGAGGCACGTTACGAGCTGGCAAAGATGTACGAGGAGGCACAGG
AACGAGACGAAGCCTTCAGGCTGGTGGGCGAAGCCCTGAGCCTGGAAGCTGGGCAGAGTGTCTACGATGG
TCTCACGCACCGCTACGTCGTGGACAGGGGTAAGATTGTATCCAAGCCCAAAAAGTACAGAACAGGCGCC
ACCAAGCGAGCCCCAACCACCAAGGCCAAATACAGACCGCGAAGACTTATCGGCGGTGGCAGTGGCGAGT
CGGCACGCAAGAAGTTTGAGGATGAGGTCACGGCACGCCTTCGGGAAAGGTACACCGAGTGTCAACGGCT
CAAGGCGCAGATGGACGCGAATGTGGCTGCAAGTGGCGGGCATGACACAAATGACCCAGTGGTTGCCGAA
TGGATGTCGGCTGCCAAGGAGTTGGTGGACGACTTCAGGTCTTTCAGGGAGTTCTACTCATGGGAGCGAT
ACGTCTCCTCTCTCGGCTACGGGAATTTCTTCAAGGCCGAGGCATCTGCAGACGGAAATACTGGCGATGA
GAGGTCTAGGTCTATTGCCAAAATGGCGAAAAGACTACACAACACCCTCGCCCCCGTCGAGACCGAAGGC
GAAGAAGCCGTACCGCAAAAGATCGAGCGCCAAGAGCATCGCGGCATCCCATTCAACGACTGGCTTGACC
TCTTCCTCGAATACGCCATCTCGCTGGCCCGGCAGCAACGGATCGGCGAGGCGTACGCCGTGTGCCAATC
AGCGCGAGATTCGATCGTCTACGGTAAGGCCAAGGACAGCCTGATGCTGATACACCTGGCCTGGGCGTCG
TGCGCCGTCCAGGCCGGCGACGAGGAGACGTGCGTCGCTATCGCGCGATACTTTATGATCCACAACCCCT
TCGTCACCGACGGCTACAAGATGTTTGCCGCCCTCACCCGCGTCTGCCAGACCTCGCCCACCTGGTACCA
GTCCGGCCCGTCGCAAAAGTTCATGCTCCGCCAGATTCGCCAGATGGACGAGATCCTGGCCGCCAAGGCC
AAGGAGGAAGAGGACGGGTTCGGCGCGGCAAGCAACCAAGGCTCGCAACCACCTGGCCCCTCGGCAGAAA
CGCAGATGGTCCCTGCCACAGCCGCCGCCGCCGCGCAACCGGGCCCCACAGGCGTCGACGCGGTCCTGCTCGT
CCTGTACGGGTGCATCCTGTTCGCGTCGACGAGCTACCAGTACGCGTTGGCCTACTTTCTGCGCGCGCGG
ACCGTCGACCCGGACAACCCGGCCATCAACCTTGTCATAGGCCTGGCCTACATCCACTGGGCGCTCAAGC
GGCAATCGCACAACCGCCAGTACACGCTAATGCAGGGCTTCTCATACATCTTCAAATACTACGAGGACAG
AACGCGCGGGGCCGCCGCGCCAGAGGAGCGCCAGGAGGCGCACTACAACGTTGCGCGCACCTACCATCTG
CTGGGCATCCACGACCTCGCCCTCGAGTACTATCACAAGGTTCTGGTCGAAGCCAGAGCCGCCAGGACGG
AGGTGCTGCGAGGCAAGGACGTTTCCGTTAGGCGTCGGGAGGATCTCAGTCTAGAGTCTGCCATGAACAT
TCGGACGTACTGTCTGAGCACAGGGGATTTGGAAGGTGCCAGAGCTGTTACTGATGAATGGTTGGTTTTG
GAGTAGACCAAAGGGATTGTTAGCATGCAACGTAGGCAGCCCCGCAACCACGATTGCTTTCAAGAAACCC
CAAACCTAACGACTGCCAAGTTTCTATTATAACACTATTATCTTATGTCTAATGCTACATGATTAGGTAT
ACAGTAGCCAAAGACCGAGACCTAATAGGATGATCACATATTGAGCAAATAAATACAAGTCAAAAACACC
AGGGGCCTAGAGCAAAAAGAGGAAAGCAAAAAAATGAGCGGGTCAAGGTGATAATATGCACACACTCGAG
AAATAAAATGATATATCCTAATTCTTCTAGATGTATATTTTCGTCGCTTTAACAACTGCCCTCGATCCAG
TCGGCATCGCTGGGGTCATCTTCTGTTTCGTCACTTTCGCTGCTTTTGTCCCAAACGTCCATCCCGTAAA
TCCCCTCGTCAAGTTTGGGTGCGACACCAAGTTCGGGCGAGTATCTGGTTGTGCAACCAGGCCTGACGGG
GCTGGAATATCCGGAG

SEQ ID NO 27 (underlined sequence); SEQ ID NO 54 (complete sequence)
<MG08863.4;DNA;Magnaporthe grisea>
TCGTATGCACACTGCCTTGGCACGGGTGATTTGAAAGGGTGTACCAGAACAGGGAAGGGCGTCGACATGG
TGGTTGACTCTCGGCGTTAAGTTACACAGTTTTGACCGATTGCGACTCAGAAAAGATGTTATTTCAAGTA
TCAAGGTTGAAGCCTCGAGAAACACTCATTATTTGCAAGCTGTAACATTTCAGTCCAAGTGGGCAGGACC
GTGTCAATCTCCAGCGGTACCAACTGCTGCTGTTACCCTGTATTAATTACAGCGTCATCAGGCATGGTGG
GTGTCGAAAGCGGGGCTCCGAAGCCGCCAAGCGCTGGACTTTAGCACAATCATTCGCCAGACAAGGCAAA
GTTGCGTGTCCAACCCATCAACACGTACCGAATTTGTGAAGACTTGACTGGCAAAAAAAAGAAGAAAAAG

FIG. 3N

AAAAAAAGATACAACAGCAAGCGTCTGCTGCAACGGCTCCCCAGAAAATGTATTGAGGGCTGTAAGTCTT
TGGTTTTACCATGGAGCAACCGTTGTTCCGCAACTCGTCCTCGGCGCGGACTGAGTTGTTTGCCAAGGTC
GGTAGGCCCATCATCAGCAAGCTTGTGATGCGGCCGTCCGCGGCACCATCGCAAGCCAACCAGTTGCTGC
AGTTGACGGATCGACTCTACTCCATCCTTAATGGACAGGTCAGCTATGACGCCTCGGCTGTGGATGCAAA
GATTGCAGAATATGTTTTCTTCCCGCTGTCGTTCGTCTTCAAGAATAAGGAGGATCACTCTGCCCGAGTG
CTAGAAAACGCCATCAAGTGTCTGCGGATTTTGATTCAGTATGGCTGGCGATCTACCATCTCTACGAGTC
TGACTCAACAGCTACTCATACTTCTCACATTCATCATCGCCGGCGTTCCTGGCCAGCAGAGGACTTCGCC
GCCGCCGGAAGAGACGGTCCTTGAATGCTACAGGTCTCTTGCTGTCTTGATCAGAGAGGCATGTCTGTCA
AGCTCCGTATCAGAATCCCTGGTTGACTCCAGTGGTCTACCAAGTCTAGGCCACACCGTAACTGTCATTT
TGGATGGCAGCACGGATGGAATGACTGCAGATATCCAGCTTGCGGCACTCGATGCCCTGAGGACTCTCTT
TGTCTCGATGAAAGACCGTGCTGCACTTGCATCCTTCCTCCCAGGCAGTGTGTCGACTCTGTCCAAACTT
CTCTCGCCACCTGCGTCACTCAAGCTTCAGAAACGTGTGCTCTGTTACGGAGCAAGAGTCTTTGGGGACG
TTCTGACCAGGGTGCTAGGCGACATACACAATAGAGATGCGCTGAGGCAGCTCACCTCAGACACGACCGG
GGAGGGAAAAGACGGCGAGCTGTCTGGGACAGAGCTATCTGCGTCTTGGCTCAAAGCTACATCCGCTCAA
GTCAGGATGGCGCTCGCCATGGTGCTCAAGTTACGATCCCACGAGTCGGATAATGTTCGGAATGCCGTTG
AGAGGCTTGCTCTATCCCTCTTAGACGAATGTCATGCGTCTTTGGCTGACTGCACAGTATTTCTCGTCGA
GACGGCCATTTTTACCTGGAAGAAGAAGATGATTCAACTGATCTATCGGGGGGTCCAAAGCATACCGCTT
CAAGCATTCGTGACTCTGCTCTGCCAGAAAGCGTAGCGGTTCAAACTACCTTGCAGGACCTGGCCATGAT
ATACCCGGAACTTCAAGATGCTATCAAGACCGTGGTACATAATATGATTACCAGCATGCCCAGAATCATG
CAAACTTCAGACGAAAAAATTAAGCAGCAGTGCATATTTGCACTCTCTCGAGGGCAGCGAATAGTGAAAG
TCCTGAATATTGACTCGTCCCTGTTGCATGAAGCACTGTCCTCGGCTCTGAGAGACAGCATTGTGGCTTT
GACCTCAAGCAAAAAACAACTGAACGTCGTGGCCGACGCTGAATTTGAAGGGGAGATGAGTGTCAACCCC
ACAGACTTGGTTACACGGCCGGGTGAAACGCGAACATTCAAGCCCATCATGCTGGCGCATGGGAGTCAAG
CAGGTACACGTGATGCCTTCCTCAGGTTGGTTTCCGGTATTGGCTCGCCATCTCAGCAGGCAGATCTGGC
TACCGACATGATCAGTCTGGCAAGGGATTTGTCAGGAATAGATCAGGTCACAGCCTTATGGCTAGCGTTT
GAGTTGCTGAAAGTAGCACTAGCCAAGAACGAGCAGGACGAGCAGTTCTTTGACTTTTCCGGCACCATGT
CAACAAATGAGCCTACCGAAGTCTTCCAAGAGCTCTATCAGCTCTCTGTCTTGATGCTGACATCACATAC
TGACAGTCTCGAAGTCGACTGGAGACTGGAGGCCATAGCTATTGAGGTTACGACTTTTGCCGCCTCTCAA
ATGGGGGTTTCATTCAGGCCAGAGCTCATTGATACTCTCTACCCTATAGCAACCTACCTGGGCTCACAAA
ATACCCAGCTAAGGCTTCACGCGATGACAGCGCTTGGCTTGATTGCGTCAGCGTGTGGATATCAGGATGT
GTCCGAGTTGATTGTTGACAATGCCGATTACATGGTCAACTCGGTATCTCTGCGCCTGACTTCGATGGAT
GTTACACCGGCGTCACTCCAAGTACTGAGGATGATGGTGAGGCTGACGGGGCCGAAGCTGTTGCCTTTCC
TAGACGACACAGTAGCCGCCATTTTTGCTGCTCTTGATAATTATCATGGGTACCCCGCCTTCGTCGAGCG
ATTGTTTTCTGTACTCTCAGAGGTGGTGCAGCAGGGTGTCAAGTCTGACGTGCTCTTGCTTGAATCGAAG
GAATCCAAAAGTCTTGACCACAGGAAAAGATCAATGGCAGCAGCAACCATCAATGATATTGAATCAGAAG
TGAAAGAGAGGATTGCAAAGAAACAGAAGAGGAGAAAGGAGAAAGAGGATCTTCTTCCAGGCGTTAGAGC
CAAACATCCTCAGAAGCCGTGGACTTCTGAAGCAAAACAGCTTCTAGACGAAAGGGAGAGGAAGATGAAA
GCCGATGATGAGGAGAAAGCAGAAGACACAGGGTCAGGCGGTGAGGTCGAGAAACCAAAGCCGGTCCGTA
CGCCAACATATGAACTGCTGTCACGAGTTACGACCTTGACGCAATATTATTTAACATCACCAACTCCGAC
TTTGCGAAAATCGTTACTGGATCTTCTCTCTACAATTACTCCATCTATGGCCCTGGATGAGGATGCATTT
CTACCCATGGTCAACTCTCTTTGGCCGGTCGTCATCTCGCGCCTTCGCGACGGGGAGCCATTTGTTGTGG
CTGCAGCTTGCAGAGCCATTGCGGCGCTTGCACAAGGGTCTGGGGACTTCCTGGCCTCGAGGATCAAGAC
TGAGTGGTGGGACTCGATGTCCAGGTGGTGCCAAAAGGCAAAGCAGAATGCCAAGACTGGTGCGACAGGA
AATGGTGGGAGAAGTGGAAAGAGCAACAATTCTGTTCCCATTCACTCCGGTCGAAATATAGGCAGACTCA
ACATGGCCTTGGTTGGCAATGAAGTTGTGCTGCCACACCGTCCACAGGGCAGTAGTAGACCTGGCAGCGG
CGGTGTTGATACTGAAAAGTATTCAGACGGCGGACTGGGAAGGTTTGCGCAGGCATCACAAGTATGGGAG
GCCACCGTCGACATGCTCGTTGCACTGGTCTCCTTTGTCAGGCTGGATGACGAGGTTTTTGACCAAATAC
TGGAACTGCTCGCCGACGAGCTCGAGAGCAATTCAGTTGCTCGCAAAGCACTCGAGGTGGTCAATGCGGA
TGCGGTTTGGCTGGCTAGATTTGAACGTGGCTCGCTGACACAAGATCTCAGTGTACCAGTCATGGACGGA
ATCAGGTTTGCTGCTTTGGCATAAGCAGCAGGTCGGTCTGGCGATGGATAAGTACACACCTAGTCATTGG
CTACAAAATACCTCTCGGGGCTACTACCACTCGAAATGGATTAATCGCCTTTTCCGCGCCAGCCTGCTAC
GTAAACCTGCCTCCAATCAACGAACTGCTGACTGTGCCGCCAAAGCATCATGTTGTGGGTTGATACGACG
TCGCAAACTCGGACCATGCATAAGTAAGCGGGGATTGGGAAGTATTCTATGCGGGTTCGTTGCACCCGCA
TACTTCTAGAACCCTTCGCCGAGTGAGCGTGCTTTGCATTGGTGCTTGGATGGGACGTTGCTGGCAGTAG
AAACTTTACGTAGTAGGTCAAAGCGGTATCCTATTGACAAGGACACCGGCGGCCGATTTGGGTGAAAAAT

FIG. 3O

CCGTGCCTCTGAGGTATTTGGAGCAGTATACGCCTTTGATCTTTGTTTAAACAAAGAGTGGCTCACTCTG
TAATCTTATCGCGCATCTCACAAAGACGCATGTG

SEQ ID NO 31 (underlined sequence); SEQ ID NO 56 (complete sequence)
<MG07222.4;DNA;Magnaporthe grisea>
TTCAATGCCTGGTGATGGCATCGGCCGTAGGGTAACTTACTATGTGCGAATTGTTGGGTAGCGTGCTCAT
TGCCCGGCGCACGAGAGTGTGCCCTGCAAGCCGCGTCGGCATTGATATTCTCGTGGCAAGGAGCATCGTG
GCAATTTGATAGATCATCAACGTTGAAGCACGTTCTCCTGATCGTTGTAGTTGATGCCGTCATCTCGAAG
TATTTTCCATTGTTATCCCTGTCGGCACTTAGCAGCTAGATCCCTGCTTCAAAGTGATCGAGGTGGGGCA
TGCTCCACTAAGATCTCAATTAACGCGACTTAGATTCACAGTCGCGTCTCATACCGCGTCCCACTCTAAA
CTCTTCCTGTATTGGCAGCATTTTCCTCCAGACGGCTCTGATCAACCTCGGTTTCAAAGTCAAATTGTCG
CAGGAAGCTAGGGTACTTGCGGCTGCGAAAATTTACGGAATTGAAAGACAGTAACGTAGTATCCGCGATA
ATTTTACGTCATGGGTGAAGCACAGAGTCCTCCCCGGCTCAGCCCAAGAAAGAAGCGGGCGCAGAAGCCC
CTCGGCAATGGCTTCTTCGGCGGTATCAAAGAAACACCAGGCAGGGCAGCACCCCCCCTCTCTAGTGCAG
CACCATCCTCGTCGCCGGCCTTTGCGACGCCCGCTCACACACTGCGGCCCTTCAACCCGCAAAAGCCCGC
CGGAGCAGCCATCCTCCCGATCCTCTTACCGCCAGCAACACTCCGCCCATTGGCCTTCCGGACCTTTACC
AAAAAACACAGCCTGACCCTCACATCGTCTGCTCTACAAGAGCTGGCGTCCTTTGTCGGCCGACACTGCG
GCTCAGGATGGCGTGAGGAAGGGCTCGCCGAGCGTGTGCTAGAGGAGGTGGCAAAATCGTGGAAGGCTGG
CAATGGCGGGGTGATAGTCGATGGGGCCAGCCCCATCCTGAAGGACATCCTCAAGACGCTGGAAGGCAAC
ATGGTTGGGGGCAAGATTGTTACTGGTGCAGGAAAGGGCTTGGTTCGGCAGAATAGTCTTCTGTTGGATC
CCTCGAGGGAACCGGACTATTCTTCTACCACCCGCCTGGGCCTGAGACCATCTATTGCACTTCAACGTGA
TGACAGCCAGTCTAGTATGGGCATGTCTGGGCTCAACTTCGAGGAAGAGCCCGAAGAAGACACGCTCAGT
GATCCAAGAAAGTGGTTGAAAGTAGTTGGGGCATATGAACAGCCACGGATGGTTTATAACGTGGCCAAAA
AGCACTTCGAGAGAGATGCTTCTAAACCTTCGATATTACCAACAGCTTCTCATAAGACCCTTTTGTTTCG
CAATCGATTCAACGTCATCCACCAGCGTCTCCTTCGTAATGAAGCCTTTCAGACATCCGCCGTCGCCGAC
ACCAAACGCGGCTCACTTGCCCGTTCAACGTCATCCCTCTCATCACAACAGTCATATAAAATCACACCCA
TTGCCAACTTACTTGGACGCCACGGCAGCCACCACATGCTTTTAGGAATGCTGGTAATAATGCCGGCAGG
TAACCTTGCTGTCAGTGACCTTACCGGAACTATTGCGCTAGACGTCACCCAAGCAGCCACCATTCCCGAC
GATTCTTCATGGTTTACCCCGGGGATGGTTGTGCTCATCGATGGTGTTTATGAGGAGGAGGATGACCACA
CCGCCAAGGGCCTCAGTGGCAGCAGCGGAATTGGTGGCACCATTGGCGGTCGATTTCAGGGCTTCTTCAT
CGGCCAGCCGCCATGTGAGAAGAGGCGAGCGACACTGGGTGTCAGCGGACCAGAAGGCGATGGTTTGGAG
CACACCATAGGGGGTGGCTTTGGATGGATTGACTTTCTAGGAGTTGGGAGCGAGCGCGCGATGGGCCCGA
GGATGCGAAAGCTGGAAAGACGTTTACTGCGCCAACCACAGCTTTCTCGACAAGACATGGCCGCGTCGGT
ACTGGAGTCCACTCTTTCATCAACGCTCCCCAGACGTGGCCGAATTATCATCTTGGGCGAGCTGAATCTG
GACCAGCCTCGTGCTCTGCAGGCATTGCGCAAGATTCTGGCCACATATGCCAACGAAACAGACAATGATG
GCAGCGAAAACGACGCCGCTGACGAGACTGTTGCAAGCACGAAACCCAACAAGACCACGACACCTTTGGC
CTTTGTTCTTGCGGGAAGCTTTTCATCACAGGCCGTAATGGCTCGGAACGGAGCTGGTGGAGGTGGAGGA
GGCGGATCCGCTGGATTAACCGGTAGCGGCGGAGGGGGCAGCATCGAGTACAAAGAATACTTTGATTCAC
TCGCGGGGACTCTAGCCGAATTCCCATCGCTCCTACGAGAATCTACTTTCGTCTTTGTTCCGGGCGATAA
CGATGGCTGGGCTTCGTCATTTGGCGCAGGTGCCGCGGTGCCTCTACCGCGCAAGGCCGTTCCAGACCTT
TTCACGTCGCGCGTCCGTCGCGCCTTCGCCACCGCTAACGCCGAAGGGACCTCGCCACGAGCGAACGCGC
CTGGGGGCGAGGCCGTCTTCACCACCAACCCGAGTCGCATGACGCTTTTTGGTCCAAATCACGAGATAGT
CCTGTTCCGCGATGATATATCAGCGCGCCTAAGGCGGGCTGCTGTGCGGCTCAAAGGCTCGTCCTCTACC
TCCACCGGCCCAGAGCACGACAACAACGAAGTGCGCATGTCGGACGACGCCCCGACAGCAGGGGACATGG
AAATTGACGAACTGCCTGATCCGGCTGTAGAGAGCGCAGCTTCAAAAGAGCCAAGACCAGACATGGTGCC
GCATGATGTGCGCGCAGCTCAAAAGCTCGTCAAGACGATCCTTGACCAAGGATATCTGGCTCCATTTCGC
ACAGCTGTCCGCCCTGTACACTGGATCACGCCTCGGCGCTACACCTATATCCCCTACCAACTGCACTAG
TGCTGGCCGACGCTACGGCGCCGCCCTTTTGTGTGACGTACGAGGGGTGCCATGTCATGAATCCTGGGCC
GCTACTCGTACCAGGGAGGAGGGGAGTTGCAAGATGGGTTGAGTATAACGTTGGGCATAGAGGAAGCGTG
AAAGAGTATGGCGAAGCTGCCATGAAAAAGGGGCAGGATCCGTTGACTAATGACACGAACATTATTGAGG
CGCCTGTCATCTGTCAAATTAGCCACCTCGGTCCAGAGTAGGGATCTGGTTCTACCATTCGAGCTCGGGT
AAATCTCTCGAGTTTCAAACAGTAAAAAAAAAGCAACGTAAAGATATTGATACATCTAGATAGCGTCATA
TTACACTGGTATCAGCCCATCGTTCATCGGCAACTGATCAATCCACCGTGGGGGTCTGAGATGTCCCCAA
TTTTTGCTAGCCCAAAAAAAGAAAAAAAAAACGCCTTAACAATCTGTAGTATACATAAGAAACGGAGAGA
GGGTCAACTCCTTCATTTCTCCGACGGCTTTTCAGCATCTCCTGTATTCGTCTGCGCGTTTGCGTCGGGC

FIG. 3P

TCGTTCTTGTTCCCGCCAAACCACCCAGGCGCTGAGGCCCAGCTCAGACCAGAAGACGACTTGGCATCCT
GTGCAGCAGCCGCACCACCCTCTGCGGCCTTGTCCTCGACGGCCCTGCCCTCGCGCTTGGCGGCGGCGGC
GGCGGCGCGCTGCCTCCTCTTGTCCATGATCTCCTTTGCGAGTTTGTCCTC

SEQ ID NO 37 (underlined sequence); SEQ ID NO 59 (complete sequence)
<MG01760.4;DNA;Magnaporthe grisea>
CCTGGGTACCTGGGTGCCTTACGAAGAATAAACTCGTCGCAAAGTTTGAGCGATGTGACAAGAGACGAAG
CTTGCGGTCTTGAGGTGGTTCGGCCCATGGTATATTGGTCAAAAGTTTTCCTTGGCAACTATTTCAGATG
ATGAGAGCAGAGCAAAGTAGCTATTATCAATGGCTACATCATGTACGGTGGTACTTCGTAGTATCCTGGA
AGCTGTCTATTTTCCCGGTTGGCGGCAAGCGAGTGCACGTGCAATCGCCCCAGTACTTTACGCTGTTACC
GTATGGTCAGTGCTGAGTACGGGGAATTGAGTTCCCCACATGTCCCGGGTCCCCCAAGTGCCTTCTTACC
CCTTACTCTATTGTTAGAGTTACCGACTCCATCGTCATTATCACCTTACGCATCACCACATCGTGGCTCC
TCGACTTAGATGCATACGAGCTACAATCATCTGGGGTCTAGCACTACATACCGCATTTTAACCAAGCTAG
CGTTGTCGCCATGGCTGTAGGCTTGGCTAATGGACGACATGCCGCCGAGGAGGAGGCGCGCGCCGAAGTG
GATGTCCTCAATTCCCGCCTGGAAAAGACAACCCAGCTCACCAAGAAGATCGAAGCATGCCTCGTGAGGC
TTGAATCGACCGGCAAGAGTGTCCGTGAGGTGGCTGGACCTCTCAATGGGGAGACCAAAAAGTTGCAGGT
TCTTGACATTGATAACGTTCTTTCCGCAATCGAGAGATTACGAGCGCCAGCCGACAGCAAAAACGACGAA
GAGCAAATTATTCGGATGGGCCCCGAGAAGGCGGACCTGCCCAACTACCTAAACTCTTTGAAACGCTTGA
ACAAAGCCCTGGTCGATATGAAGGCATCAAACCTTCGATCGAATCAACAGACAATGAATGATCTGCAACG
CCTCGTCACTCTGGGAACTACTCAATTGGCAACCCTTTTCGACAAACTGTTGCGCAGCGAAACACCACGC
TCGCTCGAGCCTCTGCATTACATAACAAAGGACAAGCCATTTCCACTCCTATCGCGAGACAATGTCAACC
GTTTAGGGCCCATATACTCCTTTGTAGCAGGATCAAATAGGCAAGGGAAAGGCGTTGGGTCCGAATCCAC
GATTGCCGAGGTGTACTCGGAGGTTCGTGGCCCATATTTGGCCGAGACTCTGGCCAACTTGGCTGCCGCA
AGTGTCAACACGGCCAAGAAGAAGAATCCCGATGCAGTTTACCGTGCCGGAACCAATGGCATTGGTACCT
ACGCCCAGGCCATGGAGCGTCTGTTCCAGGCTGAATATGAGAATATCACGAGGATATTCTCCCGGGAAGA
TTGGGCCCCTCTTTTCCAAGCCACTTGCCAGAACGCGATTGTGGAGCTTTCTCGCACCCTTCGTGAGATC
AACGCTCACATCAAAGTTCATCTGAATACGGATTGCTTCCTTGCTTACGAAATTGTTGAAATCATCTCTG
GCATGTCAAGCCGCCTTGAGGATTTGCGCGCAGCCTTCGCCGCCTGTCTCAAGCCAGTCAGGGAAACGGC
GAAAACATCACTTGGCGAGCTCATAGAGGACACCAAGAGAAAGGTTGCCAACATGCAGTCCATTCCAGCC
GATGGTGCACCCTCTCCTGTTATTGCAGAGACTATGCAGCGACTGCAAACCATGGTAGAATTTTTGAGGC
CCGTCTCCAGCATAATGATATCAATTGGCAACGGTGGGTGGAAGTCGTTGGCCTCATCACGTGGCGGTGG
CGATGCCTTACCAAGCCTGGCCTCCTTTGACGTTGGAGCGAATGGCCAGGAGATCTTTGCGGATTACTGC
AGTGATACTATCGACATTCTTTTGCTCTCGCTGGATGGCAAAGCACGGATGATGAATGGAAAGAAGCCGG
TTGTCGGTGTCTTCATAGCAAACAGTATTGCCATCACCGAGCGGTCGATTCGCGAGTCTGATCTGGCGCC
TTTGATGGAGACACGCCTGGGAATATTGGAAACATACCGAAAGAAGGCGAAGCTTTATTACACAGAGCCT
TGCAAGGATGTGTCTATGCATCTTTTCGATGTCATCCATACAAGCAAGTCAGCTCGCCCATCGTCAGGCC
AGGCTTCTGCAGACTCAGCAACCATCCTGAAGCAGCTTAGTTCCAAGGACAAGGAAAGTATCAAGAACAA
GTTCACGTCTTTCAACGCCGCCTTTGACGACATGGTAGCACGCCACAAATCTTTCAGCATGGAGCGTGAG
GTGCGTCAAATGTTTGCCCGCGACATGCAGCAAATGCTAGAGCCGCTTTACGTCCGCTTCTGGGACCGAT
ATCACGAAGTCGACAAGGGCAAGGGCAAGTATGTCAAATATGACAAGGCTGCCATTGCTGCCGTTTTCGC
CAGCCTTTACTGAGCTGTATGCCTCACGCAACCTATACATTCTCCATCTTCCCCACACCACCACAACCAC
ACCAAGCCGTCCCTAAGCTGCATTCGTCCAGCTATCAACATGCCTGTCTCCAAGAGCGGACTTTGCAGGT
CAGCATACTTGTTCTAGTAATGTCGAATTTGGGAAATCCATGCATATCGCATGGTTGGGATGATACCAAA
ACGGTCAGCAGGAGTTTTTGGCGTTGATCAAGTTAGCTTTTTATCGATCTTCAGTTTTCTTTCCGCTGCA
TGAATCATCAAAGTCTATGTGACCATCAAGACGGTAACGTATGCTGAACCAGGTCAGCGCTGATTTTATT
AATATTGCCCTGAGCAAGTTTAACAAGGACAGTAGCTGCACATCATCATATACGGGTGGCCTCGCAGGGA
CTCTTTCTTGGCTTGATACGGGTGCTTTTGAAGTAAGTAACTACCACAACCCAGTGCCAAGTGCAAAGAT
TACTAGTGAAATACTTGGACCAA

SEQ ID NO 19 (underlined sequence); SEQ ID NO 50 (complete sequence)
<MG07116.4;DNA;Magnaporthe grisea>
AGCCAAGCCAGTTCAAGGTGCCAAAACCCAAAAGAAGAGGAGACTGCCGAGCAGATAGCATTGCGCTCTT
GCCATCAGAAAAAAAAAAAAGACCAAGGGTGCAGGCTAAAATCAAACAACTGCCATCCTGTCGTGAAAAG
AATGCCCGAAACTATTGATGCTTTTGGCTGACTGCTTGCTTGCTTGCTTGCCCCCTTCCAACAGCTAGCC
TCGTAGCTAGCTGTCAAAAGCAAGCAAGGGATTATTTGTGTGATATTTTGCATACCAGTCCGACCGACCG

FIG. 3Q

ACCGACCGACTTACCTACCACCTAACCTTCCTTACCTTATTCACCTACATTTAATATCTACCTACCTACC
TACCGTCCTGATTCATTCCCTTGCCAACCGCCTAATCAAACACCGACATCACTGCAGGCTGCATGCGACG
TGAATGCGCTGCAGCAGCAGTTTTTGACAGTATCAATTAGACACCGGACCATGTGAGGGAGCTCCAAGCC
CCTCTTGAAAATGGCTCCGTCCCAGTCGCTGCCAGACCATGCGCCCAGCCCCTCGCCCAATTTCACATCC
CGAACCGTGACGCGACTTGACGAGGAAAACGAAGAGTACGATAGCTATGAAGACTTGGGCAAGACACTAA
GGCCGCTTGCCTTTGAATTTCCCCCGAACCGCCGCCTAGCCACCCATTCACGCGACTCATCCATTGAAAA
GATCACTGTTCAGCTACCACTCTCACCGCCACAAACGCAACAAGTCGCAGGGTCCACCTCTTCGGCGGCC
TCCCCGGTTGTCTCCCCACGAGCCCATGCTTCTGCCGTGCGATCGGCTACCGGTATTGGGGGCGTAATCG
AGCGGGCCATTGACCCGAAAGCTGCTGCATACGGTCACCACCGTCAGACCTCGATAGTCCACGGCATACA
ACATTCTAGGAATGGAAGCCACGCCAGCTCTGTATCAAGTCCACTGAGCCCCCAGATTATTGCCGCTGCG
GGAGCATCCTTAGCTTTAGACCCGCCCGACATGCACGCGTATGCCGTTTCGACGTCAGATATCGACTCCC
CGTTGGGTTCGAGGCCCCCGACGGCCGCGTCGACCGGGTCCACCCTAGTGAACAGTCCCGTTGGCACCGA
GAGATCATCGGCTGCCACAGATACTACCGCTCATGCGCCAACGCCAAGACGAATGCACAGCGGCAAGGCC
AGGAGGGACCACACGCAAAATCCGTCGCACTCGTCAAGGCACCACAAGGAGGAGCAAAAGACTGTAGGGG
GGTACGCCATGCATGTGCTGTTCACTTCTTTCATCGCGCACGCAGAAGAGAAACTGAACGAATGTATCAC
GCCGCCGTCCGAGCCCGAGCCCCAGGTCGAACAAATATGCGGACCTGGGGCCGACGAATCATTCGATCGG
CTGATCGTTGCATTGGGCCATATCGCCAGACAAAAGCCGAAACCTTTGATCGACTCGATGATGTTGTGGA
GGAAGAGCAAAAGCGATGCCGCGAGTGACGCGCGCAAGCAGCTGCAAATGTCCAAATCCGTACCGCCCAG
CGGTCCTCTCCTGAGGAGAAACACAGAGCCACTGCAGTTGATGTCAGGCCCTAATCCTCAAGACCAGAAC
GGTTCCATATCGCCATCGCCTCTCGCAGCGAAGCAGGAGTATGTTGTGCAAACAGAAAGACGGTCAAGCG
TCTCCACCTATCTGCTATGCCGTGTCCTCCTCGAGGTCATCAGCCAAAGCAGTTTGAGTCTGATCACTCC
TGAAATGGAAGACAAGCTGGAAGATATTATCTTTAGTCAACTCAAAGTAGCCGACCCGGAGCAACTTATA
GAATCTCCTCTCAAGCTTGCCAACTGGAATATTTTCGCCCAACTTCTCGGCGTCATGAGCGAAATCAACT
TCACAAGCGTGACAAACCGCTTCATTCAAGATCTGGAACGTTCCCTGCAGGAGCTTGGATCGAGAGGATC
CGCCTTGCCCTCGCGAGAGGAGACGGAGGGAAGGATAGAGCTCGTTCTTGGGGGGATGAAGCATTTGAGG
CTTGCGTTGACGCCTGACGACGCGTGGGAAAGGTCGTGCGAATTTATGAGCGCACTTGGCAGGCTGTTTG
CAAGGTCACATGGCCAAAAGATCAAGTCGTCCTTCTGCCAAGTCTTGGAGATGCTGCTGCTCCCCATCGC
CGGGAAGGCAACAAACAGCCAGTTCATGAAACCCCAATGGCTGAAGTCTTGAGCAATGCTGGCCCTCGA
CTTGCGCAAATGTTTGTTAAGCCACGCCATTGGTACTGCTCTTTCCCCTTGACTGCAACGATGCTCTGTG
TCTCGTCGCCAGAGACGTTCTCTAGCCAGTGGCTTCAGTTGGTATATCCGCTGCAACCGAAGCTCAAAGA
TCGATTCTCCAAGCCGCTCTGTCTGCAAGTCGTGTCCAGACTTGTTTGGACATATCTCTACCGCACCAAC
GAATCCCCAGCTTCAACCGTACGCAAGTTGGATGAGGTCCTCAAGCTGGTGCTCCCAACTGCAAAACGCA
CTATCAACTCTGCCGACCCAACTGTGTCTGAGCCTTTGATACAAATCATCAGAATCATCGGGTTCAAACT
ACCCGAGTTCTGTTTCAAAACAATAATATTTCCGCTGATAAACGCAGACCTTTTCGCAACCAACAGGGAG
CTCAAAGTGGATAGCTTGGAACCAGACAAGGTTGTTATTGGAATCCGAGCATTTTTGGCCGTGATGGCGG
ATCTCGAGAAGGGTGACCAGGGAAGGCCACCGTTCCCCCAACAGTACCCTATAACATCTGTGCCTGAACG
CGCCTCACAAACACCGATAGCTAACGGGTCGTCAAGCCCGCCGACCCCTGGAGGACCCTTAGATGGAGTG
GAGGACGAGGGACTCGCGCGCCGCGTGTTGACGTCTACTCTCAGCGAGTCTGTGAAGGAGTACTACACCA
GGTTTTGCCAAATATTGGGCAAGATTACTATAATGTGTGACAACACCTTTGGAGGCCAGGCCGCCCTCGA
CGAAAAGTTCAACTCGCCTACTCCCAAAACACCTATCGCCGACACCTTCAACTTTCGCCGCGATGAGCAC
CAAAACCCGACAGATCAGAAACAGGCCTTCTACGAGCTCCTGCACGTGGCCGTCCAGGCATTACCCCGCT
GCCTATCTCCTGACATTCCCTTCAACTCACTGATTAACCTGCTGTGTACCGGAACTGCCCACGTACAATC
AAACATTGCAGAGTCATCGGCCCTGTCCCTGAAGGCCATAGCTCGCCAGTCACATGCCCAACAAGTCACG
ATGGGGTTCTCCCGCTTTATCTTCAATTTCGACGATCGATACTCTACCATGTCTGACGGCGGCATGCTGG
GGGCTGGGCACATTGAGAATACTCTGAGACTATACGTCGAGCTGCTGCATATATGGATCGAGGAGATTAG
ACATAAGACCAAGGAAGCAACGGGTGCAGTTGGGGACACAAACGCCTCCGATAAGAGGGGCATGAAATTA
GACTTGTCCAGCATATGGGCTGAAGTTGATCAAGCTGAGGCACATGGACTTTTTTTCCTCTGCTCCCAAT
CGCGCAGAGTCCGGTATTTCGCCATAACGGTGCTTCGTCTCATCAAGGAGTTCGACATGGCCCTCGGGAA
AGCAGAAAGCGATGATGAGAAGGAAGCCGTGAGATTGATAGATGTCCTGGAGAAGGACTACGTACAGGTC
ATGACTTTTAACGATGATCATCTGTCAGTGGCAGAGCGAAGCAGATTGCAAAGAGGGATGCAAGACAACA
ACAGCCAAGGCCTGATTACGCTTTGTGCCAGCGATGTTTCCTACGACACCACTCTCTGGTTCAAGGTGTT
TCCGCATCTCATCAGGGTAGCTTATGACCGATGCCCTTTCACCATTACGATCGGCCGGGACTTGATTTGC
AACAGGATATTGCAGATGTACAAAGCGATAACCATCATTTCTGAGCCGTCCAGAGGGCTCTACTACGGGT
CGGATCCCGGAAGCGCCCGTCTGACGGGGAGGACGCCAACGACACAGCCTGAGCTGCTGGTCGAGCAGTG
GAAGCTCTATCTTGTCTTTGCGTGCACAACAATGGCAGATCCTGGCAGCCCCCAACAGCCGAAGCAGCCA

FIG. 3R

CCGCCTCCCCAGGCAGCCCAGCACGGCCGAAAGGGCTCCAACAACAAGTCTCTATCGGCAGACAAGATTG
TCACGGCTCGCACTCTCTTCAAATACCTGAACCCACTCTTGTCGGTGAGCTCTGCGTCTGTCAGGGAAGC
TGTCGTTGTGGCGATGGGGTCAATCAACATTAATATCTACCGCACGCTCCTGGAAGAGCTTCAGGGGCAC
GTATCGCGATGCAACGACGAAGCCAGGGCTCGTATTCACCAGCGTACCAATAGCAGCCCTCGTCGCAACC
GCAGGATGGATTTGCTTAGGACTGAAATAACTCATGTTTACAAGCTCACCTCTCACTTCCTCAAGGATCC
TTCGGTAATACAGGATGACTGGATACTTAGTAACCTGGTGGCGTATTCCAAGGACTTGAAACTGTTCTTG
ATGGATGGAGAAGTTCAGATGGACTGGGAGTTTCAAAAATTGCGGCGCCACTACTGTGGCTTGGTTGAGG
AGATCTTCGAAGGGATCAAAAGAACCAAGGATCCGTCCCGCTGGATGACTTTCGAGGCTCGCAAATCTGC
GTTTGCACTCATGGAAGATTGGTGTGGGTTTTCGCCCAACCACAACCAGATCCGACATCGTGAAGATACA
ATGCGGCAATCCGTTATAGAGCAACAGTCTGCTGGGGAGCGCGGCACACTGACTGCCGCAATGGAAATAG
AGAAGAGAAATCTCAGGACTGCAGCACTGAGCGCGATGGCGGCCCTGTGCGGCGGCCCTATAAGTGTTAC
TACCGAAAGTGGCGTGTCCCTTCAGTTCGACCTCAGGCGGATGCTCAACTGGATCGAGTCGATATTCACT
ACCGGCAATGACCGCATGAAGGTCACTGGCAGGCGAGCCCTCAAAAACCTTCTCGTCCACAACCAGGAGT
ACCCGTACCTGCTGGAACACTGCATCATGCGTTGCTACCTGGCAAATGTCCCCAAGGTGCTAGAAAGCTA
CTTCAGCGTCAGCACTGAGGTGCTTCTGGAATATCCTGAGTATCCAGCGTCTTTCTGGAAACTGCTGCCC
CTGTGCCTCTTCACTCTTGGGAACGACCAGAGCGATATACGGATAAAATCAGCTCGCATCCTCAGGGCTC
TCGAGGAGCGGCAGCAACCACCGCGGTCCTCCAAAATCCAAGACTTTGATATCAGCATCTCTGATAAGAC
CAAGGCAGTCTACAAGCTTGCACAGTATAAGATCTCGGAGCGTCTCTCTAAGCAGTATACGGAGCTGGCA
TTTTACTTCTTCTCGCAGCTTTCACTATATTTCAAAGACCTCGAGTCTGGTGCGCAAAGGAACATGGTTG
CTGTCATCCTACCGTGGATCCAGTCAACAGAACTGAAGGTCGACCCCAACGGTGGCCCGGTCGCTCAGTC
ATATATGCTCTTGGCCAACCTACTGGAAATCACAATCAAGGCCAGCTCTGCTCTCCATAACGAGGTGCAA
GCTCTCTGGCAAGCGCTCGCGACCGGCCCCCATCCTGGCAATGTACGACTCGTTCTTGACTTCATAATGG
CGCTCTGCTTGGAGCGCCGGGAGCAAAACTTTGTTGAATATGCCAAGCAGATCGTTGTCTTTCTCGCCAG
CTCCAACAGCAACCCTGGACAGAAGGTTGTCGAGTTCCTGCTGTCATTCATCACGCCAAAAAACATGGTG
CCGAACGAAAAGCGGGACACCCCCCCTCCACCTCCAGACGTTGGACTTCTCCCATACTGCGCCGACTTGT
CCGAGGCTCTGCCTGTTGGTACAAAACAAGCTGGTTTCTCGACCGGTCAACTTTCGATGATACTACTCGT
AGACCTAATGGTTTCACCTGTCAAGGTGGTGCCGGATAATGTGCCCGTGCTGCTCCAGGTGGTGATTGTT
CTTTGGGACCACTACACGCCCTTGGTCCATGAGCAGGCCCGCGAGATGCTCGTTCATCTAATCCACGAGC
TCGTCATATCAAAGCTAGACGATGCGACCCCTCAGTCGAAAAAGAAGGCCATTGAGGATCTCATTGATCT
GATTCGCCAACATGACAAGCTTGTAATCTGGAACTATGAGGATAGTAACGGCAAGGCCGAGGACGATGGG
AGCAACGTCCCACCCAGCATGGAGTATCTCGCCGCCGAAGTAGTCAACACATTTGAGGTTACCTACCCAG
GCATCAAAGACCAGTGGGCTAGGCTGTCGTTGATCTGGGCGACTTCCTGCCCGGTTAGACATCTCGCCTG
CCGCTCGTTCCAAGTCTTCAGGTGTATACAGACGTCCGTTGACCAATACATGCTGGGAGACATGCTCGTG
AGGCTGTCCAACACCATTGCCGACGAGGATCCCGAGATTCAAACATTTTCCATGGAGATCCTTACAACTT
TGCAGACCATAATCGCGAGTCTTGATGTCGACAAGCTCCTCACCTTTCCTCAAATATTCTGGACCACCTG
TGCCTGCCTTGAATCGATCAACGAACAAGAGTTCCTTGGCGCCGTCAAGATGCTCAATGAGTACTTGGAC
AAGGTAGACATGACTTCTCCTAGCCCACTCCTTTACAAAGGCCTACGATCTGCGGTTTGCCTTGATGCTA
CATTAGCAACTCTCAATCGACTAGTGCCCCTGCCGAGCGACCCCTTGATAGGAGACGATAGCCGCGTCTT
TTTCACCATTCTCGCCAACCTGCCGCGATTCTTGCAGACAATGGACCAGCCTCGGCCCCTGAGTGAGCCT
GTCAGCAAGACCATCGGGGCTCTTCTAGATGTTGCCATCGAAGAGGGACATTCACCCGTGGCTCTCGTTC
TGAATGGCTTCCTGTCCGGCAACTATCGGAATGGCACCGAGCTCGTACATGGCGTCTTTGCGGCCTTTAA
GGATACATTTTCGACGCAGCTCGATTTCAAAATGATTACTATGATTATGGGCTTCCTCACAAATCGCACA
CCCTGGGTCACGTCCAAGACGCTGCAAATTCTCAAGGTCATCATCTCGGAGATTGATATGAAGCGTCCTG
ACATTATAGGGCATGGCTCGGACCTGCTTTCTCCTCTTCTGAGGCTGTTGCAGACCGAGTACTGCATGGA
AGCTCTCGGCGTACTGGACAACATAATGAACATGTCGGGCTCGACAATGGACAAACAGCACTTGCGCATG
AGTATGACGCGGTCGACATTCAAGGCTATCAGGAAGGAATACGAGCGAGTGCAGAGCCTGTTTGGCATAC
CCGAGGAATCTGGCTGGGCGATTCCTATGCCAGCCAAGAAGACAGAAACCACCCGGGCGAACGTCCATGC
CGCCTTTTACATGTGCCAGGGAGCCGAGGGTATCGTTACCGATGTCATGCCCACCCCCGAAGTCGAGTTC
CACGCCGACGAATTTCCCTACGGCTACTTCCCAACATCCTATGAAAGGACCGAGACAATGTTGTCGGACG
AGGCTCGTGGGGACGGCAACGGAGGTGACGTGGTCACGAAGCTAGATAGCCTCGATGACTTCTTTGACGA
TCTTAGTATGAGCCCACCCAGCGAAGCACACTCATCGAATACTATAACCGAGTTTATCCCGGATAACAAC
TATGACATGGAGGCCCAGCTGTACGATGAGCAGGTCCTTCCCATCCTCCACCAAGCTTCGACTGCCAGCT
CTTTTCAGAACGGCTTCGTCGATAGGCCTGCGCCATTGTCGAGAGACGGTTACTCTAACACAATGACACC
TGGAGCGTTCAGTTTCGACCAGGAACTGACATCGACCACGCGCCCAGGGCTGCACTCCCGGAGTGTGACC
TCGCCGTCGGCTCCAGCATCATACCAGCCTCATCTGGGAGAGGCCATCGCATCTGATGATGAGCTCTTCT

FIG. 3S

CGGACGACGAGCGCTCCAACGCCGGTGGCGCACCGCCCGAGGGCTCTTTCTTCCTCGAGAATATGGTCAA
GCCCCTTACTCAAAGCACTCGGACTCGCATTAGACGCTTGACCGGCAACAGGTCGAAGGATGAACGACAG
CATCTAGATATTTCCCGTCCCGACCGCCCAGGCCCTCCTCAGGTACCCAAGCTTCCCAGTTCATACCTGC
CCAAGGGGTCCCCGCCTGGTAGTGGGACATGCTTTGAAGATGATGTTTCTTCACACCTCACAACAGCAT
ATCCTGTCGATTACAGCATGCATTCGATTAGACTTTTACCGTCACAGATCTTTTCAATTTTGTTTCAAAG
ATACCCTCGCTAATTCATGATCCATTTCCCCTCTATGTTTTGTTTTTAAAAGAGCGCAGCATCATTTGGG
GCTTTAACCTTTTTTTGCGTTGGACACAATCGGACTTTTGTTGCACCATGTATCCAAACAAGTAATACAGT
CTAGCTAGGGATCATTCACATGGCAGAAGAGCAAAAATACGAGAATTTCTACATCGTGCCCGCAGAGTTG
AACAAACCTTTGAAGACAGTACACGACCCAAAAAGGGGACGAAGTTTGGCAAGACTCGTTGGCTTCAATA
TAGCTCCCGGAAATTTCACTGCTTCTGTAATGTAGGTGATCATATCAGCAATCTTTGATTCTTCTGCGTT
AAAAAGGCCATGTTCATCGTAAAAATCGTCGAGACCAACCCTTGACAG

SEQ ID NO 33 (underlined sequence)and SEQ ID NO 57 (complete sequence) wherein the first double-underlined/boxed nucleotide may be a G or A.
<MG03872.4;DNA;Magnaporthe grisea>
TTCCAATTGATCTCGACCATGGATATCTCATGCATGAGTCTCGATAAAGTTTGTATATCATCAGCAATGA
TTGTGAGGCAAACGAGTGATGAAATGAGTTGGCAGGCTGTAGAACATGCGAAACTAGGCATAAAAATCTC
TAGCATACAAGAACTGTTGCAGTCGATGGTTAGAATATACTCGGTTGTTTTACTGGGTCGCGGTAGTAGC
GAAGTTTAAACAGCACCAAGAAGCAAGTGGATCCCGTTTTGATGCACGGCTGACTAATCTAATGATGCAA
CGTCAACATGCCCCGCTCCTCCCCAGCTTGTCTTTGCAGCTGCAGTTCAAAAAAAAGTTGCTGATAAGAT
AACACGAGAAAAGTCTCGAGCTCCCTCTTCTATCCGCCAAAGTCCTGCCTACTGCCCCAACTGCCTACCC
AACTTGCTTCGCGCAGTGCCGACAACCCCTATTATTCACCAGCTTCTTGAATAGAGCCGCGGCTCATCCT
GATTGAAGCAATGGGTAAACGAAAGAGCGAACAGCACCGAGGCCACCATGGGCGCAAGAGGAGGAGATTG
GCGGCCGAACGCGAGAATGAGGCGGCCGAGGAAGCCAAGCACAACATCGAGGAGCAACCCGCCGAATTGA
ACATAATCCATGACGACTTCATACCTCTCGATGAAGACACCGGTGCAGCAGGCCCTCCAGAGACGCGCGA
GTATTTTGGAATGCTCACCGAAGACGAGCAGGAGGAGTTCAAGCGACTAGACAATGCCCTCGAGGACGAC
GACCCGAACGTGGACCGTGAGGAGCTCCTCGCCACGATATTTGAAGTGGCCAAGGGCAAGGAACTCAAGC
TCGCCTGTAGTCAGTCGTGCTCGAGGTTGATGGAGCGGTTGATTCTGCTGTCAAACACAAGGCAGAAGAA
GGGCCTTTTCGATGCCTTTGCGAACCATTTCCCGACGCTCGTCACTCACAGATTCGGCAGTCATTGCTGT
GAGCAGCTGTTCTTGCAGTCTGCTCCGGTAATCACCCGAGAGCTGACTGGAGAGGTTGAGGGCAACGATA
AGGATGCACAGGAGGAGGGCGCCGGGGACGGTGCAGAGAAGCAGCCCTTGTTGACCATGGAGGAGCTGTT
CTTGTTAGTCTTGGATGAGCTTGAGGAGCATTTGACCGTCCTGATGACCGACACCTTCGGCTCCCACACA
CTCCGAGTGCTACTCACCGTCCTTTCCGGTAGGCCGCTGAGTCAAGTGGCGACCAAAAGCCTACTTCAGA
GCAAGAGAAAGGAGCAGATCGCTTTACCAGACGGGTGGACAGCAACGGAGGAAACTGGCGACCAACCGAG
AGCTGTTCCGGCATGCTTCGATATGGCAGTTCGCAAGATTATATCCGATGTTTTAGTTGCACTAGACCCG
ACCATGCTCGCCGTCATGGTCAAGCACCCTACTGGCAATCCAATCCTGCAACTGCTGCTCGAGCTTGACA
TTGCGCTCAATACAAAAGCCAACAGCAAACGCAAGTCAAAAGCTCAGGAAGCGGAGGAGGCAAAGTTGGA
GGCAGCTGAAGAAAAGCCCAAGGAGGAAGCGGGTGCGCCACAAACCTTGCTTGAGCGCCTACTTCCCGGT
GCACCGTCCACCTTGAGCGAAGAGACCTCGGAAGCGGCAAGGTTTGTCAGTGGCACGATCTACGACTCGA
TAGGATCACGCCTGCTCGAAACACTCGTAAGCCATTGCCCAGGCAAGATATTCAAAGGCCTGTGGAGTCA
CATCATTGGGCCTCGGTTTGAGACACTCCTCCGTAACGAGACGGCAACATATGTAGCAATGAAGGCATTG
GTCAGGCTGAGTCGAGAGGACTTGGCGGACGCCGTGCTTAAGACGATACCGAAAGTGGAAATGCTAGTGT
CGAAAGGCCGCTTCAATATCTTGACGCTGCTGTTTGAGCGCTGTCATGCCCGTGAAGCCTCTGTATCAGC
AGATGCTCTGCTAAAGGCTGTAACAGAGGCGTGCAGCGCATTGGGTGGATCACTTGTCCGCACGCTGTGT
TATCTTGACGACGAGGACACCAACAAGGAAGAAAAGAAAGACAAGGTCAAAAAAGCTGAAAAGGACCAAG
GCGACAAGAAAGACAAGAAGGATAAGAAGGACAAGAAGGATAAAAAGGAGAAGAAGGACAGAAAAGACAA
ACCGGCCGTTTCTCAAGAGAAGGAACCTCTTGCAGATCCACCAAAGAAGAAGGATGATCTCATCCGCAAT
GGCACCAAGTTGGCAACAACCATGATACAAATTGGTGGGAAACCGGCACAGGCCGTACAGGGCTCTCTCC
TCTTCCTTGACCAAGAAAAGCTGCTGCACCTAGCGACATCGTCAACCGCGACAGCCAAATTCTTGACAGC
AGCCTTGTCCGCTCCGTCTTCGAACCCCATCTACCACAAGATGCTGGTAACGGCACTCAAGCCGCACGCC
ATGGAGCTCGCGCATTCGTTCACCGGATCATTCGTGATCAACGCCGTCGCGCTGATTCCCTCCAAGGCAG
AGGGATTCGCGCTTCCCTTCTTTATCAAGCAAAGCATCGTCGAGTTGCTGACCGCTGACGATGCGAGCCT
ACGCAGCACTCCCCAGGGCAGGAAGGTCTGGGCTGCGTGGAAGGGCGAGCTGTGGGTTCGCAAGCGGGCA
GAGTGGATACGGTGGGCGARGGAGGTCGAGCCCGAGGAGGCCCGGTGGGCAAAGACGCCACAGCCGAGAG
TCAAGGAAGAGCGTCCGGGTCAGAAAGGGGATAAGAAGGATGGGAGAGGCCCGAATGGCCGTCAGTTTAC

FIG. 3T

AGACAAAGATGGCAAGGACAAGGACAAGAAGAGAAAAAAGCAGGAGGCAGATGAGTGAATGTCAGCCTAG
AGCCGTAACAGATTATTGGCTTCTGTAGATACCCCAGAGTCGACGAATAAATGTAACTCGGTACCCATTC
CAGGAGTTGAAAATTTTGACAAATTCTGATCATACTGTCACATCACGATGATGGTTTTATGGAATACATT
ATCAGGGGTATCGCCGTACCATGAACGCCGGTCTATAAAATCAGATCTATGTCTCCTCCCCATTGAAACA
CCCATATATCTAAATCCCAAAAGCCAATCACAGTCCATCAAGATGAAGTAAGAGGAAGGCTGCCTTGGTC
CCACCGCCGTTCTAAGTGATCTGGCCGAATGGTAAGTCATCTATACCATGCGCTGACGCTAGTCTATGAT
GGGGACCACCAGATGAGGACGTACAATTTGCTGTTCTTGCATGACCGTCTATGATTGTGTTCATGAGTAG
TAGCCATGGCTGGACTGTCTCGACTCTGAGCTCTAGAGTGTTTTATGCCATTTCCCGTCAGCAAACCC

SEQ ID NO 35 (underlined sequence); SEQ ID NO 58 (complete sequence)
<MG04185.4;DNA;Magnaporthe grisea>
GTGTGGGGGCGATCAAGTTTACTAATGCTTGTCAACAGGGATGTCACTCACCCCTGTCCCAGAGGTGCAC
GTCCCCCGGCAACCCGACACGGTTTGTGTGTGGATTACTTGGGCGTTTGTGTTTATGATCGGTCGGGCAG
ACTCCAACCTCAAAGTTGCGATCTCGACGAGAAGAAAAACCCTGGCCACTTTCGGACATTTTCTGTCCCT
GCCAAAACGAACTGAACCGCCATCAACCCAAATGCTCTACAATCGCCTCCTGCGCCACCTTTACGAGAAA
CAATCGCTGAAGACTTTTGCTGCCTGGTAAGATTTCTCCTCATCTTAGGTTTGCACCATGTCCAAGTGCC
TTGTCTGCCGCGGCAATAATCCCTGGCCACGCTCGGCCGCATGAGCAAAAACGAGCTGACCCATATTCTA
ACTGTTGCTCTTTTATCCAGACGCCTACCCTCAGCTAGCACCAATAAGCAGCTCGACTATCTCAGCGCAA
ACTAGGAGATATGGCCGAAAAACTTGATGAGGACCAGGTTTCCGGTCTCATCGCCATACTCCGCAAGGAC
GTCTCGGTCGACGCCAAAGTTCAGCAAGTAAATGCGGTCAAGTCCAGCATCAAGCAGCACAATGTGCCTG
ATAACTGCGTCGTACCGGTATTCGAGGCCTTGCGCATCGCATCTACCGCCCAGCATGCCGTCCTGGTCAA
CGCCGGCTTCACTGGCCTCAACCACCTTATAACACGAATGTCGCGACAAGATCCGAAGTACCTTAGCAAA
GAGGCTGTCCGTCTACTGCCGCTGCTCACAGAGAAGCTTGGAGACCAGAAGGAAAAGTTCAGGACAGTTG
CTACGCAGTCACTCATCACCATGTACAAAGCCACACCCGCAGAAGTCGAGCGAGTGATCCGCAACGTAGC
CATGGTGGGTAAGAACCCCAGAGCTAAGGAAGCAAGTCTACACTGGCTTCTTCAGATGCACCAAGAACAT
GGGCTCCAGTTTCGCGCCTATGTGCCTACCCTTATGGATTTACTTGAAGACGCCGACGCTGCTGTTCGAG
ACGCAGCAAAAACCACCGTTATAGAGCTGTTTCGAAATGCGCCAAACGCCGCCAAATCAGATTTGAAAAA
GCAGCTTAAGAATTTCAAGGTGCGCCCTGCGATCGAGCAGGCCATCGTCAAAGAACTCGTTCCCGCATCG
CTCTCGGCGGCACCCTCGGATTCCGACGCTCGACCAGCTTCCCGAGCCGAATCCACGCGATCAACACGCG
CAAATCTTTCGGCAAGCACGACATCGGCTGGCATCGAACGTCCGGTTACCCCTGGTCTTCTCGACAGCAA
ACCGGAAACCGTCGATCCCACCTATGTCAATACCCAAAGAGAACTAGATGATATCGTCAAGGAGATGCAC
CTCTATTTCGAGGGCAAGGAGACGGAGCAGAATTGGCTGCAGCGTGAAGAAAGCATTAAGAAGCTCAGGC
GACTGTTGGCGGGTAACGCCGTCTCAGACTTCCATGACGCGTTCCTCGGCGGTGTGCGCGGACTTTTGGA
CGGCATAATCAAAGCCGTCACTTCACTGAGAACTAGTCTTTCTAAGGAGGGCTGCAGTCTTGTCCAAGAG
CTGGCTCTTGCGTACGGTCCGGGCATAGACCCTATGGTGGAGATTCTTATGCAGACTTTCATCAAGCTTT
GCGCTGCGACCAAAAAGATCAGCTCTCAGTTGGCCAATGTCACCGTGGACACCATCATCGCAAAGGTCAC
TTACAACCACCGGATTATGCAACACGTGTGGTTTGCTTGCCAGGATAAGAACGTGCAACCACGAACTTAT
GCCACCGGATGGTTGAAAACACTGCTCAACAAAGAGGCTCAGCAGAAGTCACACATCGAACACCACGGAG
GGCTAGATTTAGTTGAAAAATGCATCAAGAAGGGGCTCGCCGACTCCAATCCATTGGTGAGGGAGAAAAT
GAGGGTCACTTACTGGACTTTCAACGAAATATGGCCCGCAAGAGCGGAAGCGATTATGGAAGATCTGGAT
GCCACGGCTAAGAAGCTCCTGCAAAAGAGCTCCGGAAACACGAGCTCGCCCAAGCCGGCCGCTGGTGGTG
CCCGGCCTGGCATGGGTCTTTCTAGGAGTACCATGACCGCTTCCAAACCTTCTTTAAGAGACGCCATGTT
GGCACAAAAACGGGCTTTAGCTTCAAAGAATCTCCCAGCAAGGCCTGGATCCGCCATGGCACATTTTTCA
CCTGTGGGGACTGCATCTTCAGCCTCATCTGCAGCGGTTACTTCCACTACTACCGCCAAACCCCCTGTCC
GCCAAAAGCAGCTGCAGGAGGCCCCCACTTCCACTGGATCAAATAGCCTTTCGGTCGCTCCAATGCGACC
CGGTAGAAAGAGACTCGAGCTGGCAGCAAGACCTGCTACAGCTGGCCCCTACTCTGTGAGGACACATGAT
ACAGTATCATTGGAGCAGAACAGCCCACCAGAGAAAACAAGGCCAAAGTCTGCTGCCAGTAAGGCGGCTG
CTCCTTCGCCTCGCGCGAGTCCGGCAAAACCAAAGCCTACTGCAATCGCTCGCACTCTTCGTGAGAGCAG
CCCGTCCAAGCCAGTTGATGCGCCCAGTCCGGCTAGAACCATGGCCTCACCGATGCCTGGGTCTCCCGTG
TCCGCGCCTCCTCCAGTTCTGACCGAACCTACCCAGGAGCCAGAAACGGAACAGCAAGAGACTAGGCCAG
AATCAAGGACGAGCACGTCTCCTCATACACCGCCACGGCCGGTCAAGGTTTATGAAGATCCATTCACGGC
GGACGAACCTTCGACTAAGCCGAATTTAACAAGACCTGTTCTCGAGGATATCCCGATTAATGAGGACGCC
GCAAACCTTGTTCGACCTGTCGAAACCGACCCTGTTGTCGCCAGCACCGACGGTGGCCCGCCAGACAAAG
CCAAACACGATATCCCCATCGAGAAGGTACCGGATGTTAAGGCACAGATTCTTGCTACTATCAAGCTCCT
TCTCAAGAGGGCCCGCGACAACTTTCAACCACACGTATCTCACGCCCTCGAATCGCTCCTCGAGGCAAGA

FIG. 3U

GGGGTATACGAAGCTCGTACACATATAGTCTCAGGCATGGAGCTACTGGCAGACGAACTGGTGACTATAG
GTGACCCTTCGGAAATGGTCGTAGTTCTGACACAGGCCCTGCAGGGTGTCGAGATGGACGCAAGGGGTTG
TCGGTCGCTCAACATGGGCTTGCACGTTCTGAGGGAAGTTGTCGATGCGCGTCCGGATTTTCATCCGACC
GAATCTGAACTTGCCGCCCTGAGCGGGTTGGCCGCGCGCTGCCTTGAAAGCCATGAGTCTGGCGTGCGGA
TGGATGCAGTCCAATTGTGTGTTGCCCTGCATGCCCGTGTGGGCGATACACGCTTCTGGGACAACATCAA
GGGTGTCAAGGAGGACCCTAAGAGCCTCATTACCTACTACATCGTGAAAAGGCAGCGCGAACATGATGCC
GCAGCCAGTAATGGATTGTCAGCAGCTGCCACTGCGACTGTCATTTGATTTGCATGGGGCGACACACATA
CCCAGAACTCGCCTTTTTCTTTCGACACTTTATGGCGGCGCCATATACTATTTTAATTTCTCTCGTCTTT
CCTAGCTCGTCTTTTTCTTTCTTTTTTTTTGTGCACCTGGTACGGAGTACAATACAACGTCGGCTGGTAA
AATATGCCAGGCGATACCGGACTGGGGGTAAAATTAGGACTGCAAAGTGTTTGTTTGGCGTTTCGAATTT
CATTTTGGGTGGTGAACTGGCTGTATGGGCGGGCATCAAGACGACTTCCCGCCAACTTGACTCCTTTAAC
TTGAAATCTTGTTCCATTATCAAGTACATGTCAAAGTAGGCTTGCTGGGTATACATTGTAACTACAAAAT
AGGGCGATTGTAAGCTTGGTACTTAAAATATAGGAAGACTTCACTAAGGCATGAATAAGCTATACGTTTT
CGTTACCGACGTTGCTTCTGTGGTCTTCACATAGGCCAACTGTTGACCTGATGTAGTT

SEQ ID NO 556 (underlined sequence); SEQ ID NO 486 (complete sequence)
<MGG09222.5;DNA;Magnaporthe grisea>
CATTAGGGTCATTGAGTTTTGACTCAGGTCCTACTAGATACCTTACCTAGTACCTCAGCTTGGTTGGTAG
ATTTACCTTGGTTCCTTACTCGTCAGAGATTGACCTTGGAGATGAATTACCTTAGGCGTTCGGACGTCAA
TTCAGTTCTCCACTCCTTTCAACGGAGCCTGTGTCCGAAATATCACGTGAATCAACGGCCAAGCGGAGTG
GACCGTTGGTGGAAATGCTTCTATTTGCCTGACAATCAAGGCATAAAATAGCTTTAGGGTTCGAAAATGT
GAGCGGGGCCTAGCCCACAAGGAAAAGTGACCGGGGCAAATTCGCTGCGCACCCCACCCAAAAGTGCAGT
AGAGGAAAATATACGTGCCTGCCCGATTTCGACCTCTGCCACTTGAAATCGCCCATTCGACGCCGACCCG
AGTAGACGACCGACCAGCAAACCTCCAAAACACCAAAGGCACCGGGCCCCCGAAGGAGAATAAACAACAC
ATCAGACACAATGGCCGACGCAGCACCCCGTGGCGGCGGTTTCGCATCGCGTGGAGGAGACCGTGGCGGC
GACCGCGGCCGTGGTGACCGTGGCCGTGGACGTGGACGTGGCCGTGGCCGTCGTGGCGGCAAGTCCGACG
AGAAGGAGTGGCAGCCCGTTACCAAGCTCGGCCGTCTCGTGAAGGCCGGCAAGATCAAGAGCATGGAGGA
GATCTACTTGCACTCGCTCCCCATCAAGGAGTACCAGATCGTCGACTTTTTCCTGCCCAAGCTCAAGGAC
GAGGTCATGAAGATCAAGCCCGTCCAGAAGCAGACCCGTGCCGGTCAGCGTACCCGTTTCAAGGCCATCG
TCATCATTGGTGACTCCGAGGGCCACGTTGGTCTGGGTATCAAGACCTCCAAGGAGGTTGCCACTGCTAT
CCGCGCCGCCATCATTATTGCCAAGCTTAGCGTCATCCCCGTCCGTCGTGGTTACTGGGGTACCAACCTT
GGTACTCCTCACTCGCTCCCCGTCAAGGAGAGCGGCAAGTGCGGTTCCGTCACTGTCCGCCTTATCCCTG
CTCCCCGTGGTACCGCCCTGGTTGCCTCGCCCGCTGTCAAGCGTCTCCTCCAGCTTGCTGGTATCGAGGA
TGCCTACACATCGTCGTCAGGCTCAACCAAGACCCTCGAGAACACCCTGAAGGCCACTTTCTCGGCCGTT
TCCAACACATACGGTTTCCTTACCCCCAACCTGTGGAAGGAGACCAAGCTCATCAGGAGCCCGCTGGAGG
AGTTTGCCGACACCCTCAGGGACGGCAAGCGTTACTAGATGTTTGGGACGATGGTTTAAATTTTCTGACG
GTCGTCGGGGCGTCTTTGATCTGGCTTTCTTCATTTGCATGGGTTTACGGACGGGGCATCAACTTTCGGG
GTCATTCAAAAAGCAATTTGTTATGACCTGATTTGAACGAAATGAGACTTCAACCAACGATGGATTACCA
TGCGGCTCGCCAGTGAAAACTAACTTAGTGTCGAAGTGATTATGCAAAAAGGGGTTGTTATCCCAGGCAC
TGTGCTGGCAAGTGCCATGGCGTGCGAACAGAACAAGACTTGGCGTCATTTTGAGGCATCTACCGACCAG
TCTTATACTGTTAAGGGGTTAGACAAAGATCAACACGTCGTTATGCGTGGAATCGGTTAAGGAAAACATC
TCGCCTGGTAGTAATCAGGTGCTCATGTTCAAAGGTCATTGTGTATCGGGCGCGGCATACGAAGTGCTCG
CCCCGTTATCAACTACCTAGGCAGGTAGGTAGGTACCCACCTACCTTT SEQ ID NO 460 (underlined + boxed sequence); SEQ ID NO 487 (complete sequence); SEQ ID NO 561 (boxed sequence)
<MGG00961.4;DNA;Magnaporthe grisea>
Gcctcgaggttgccaaaagcgggaccacatgatgtcagcagcccagtatacgctatggtacaagttgtac
aacggctaggtacaaattggggtagcggggaaagccactaactacatcacaaaatggttcctcttcgatt
ttcaggagtccttttcgctgtaaatatcaaataaaggttaaatctaagtgtgcatgcatatgtcgtatga
caaggaagtccttggacaaatgtacctatcggattggggaggctttcactgtggactgggggtggaaatg
taggggaccttccgtaggtaggtagtagaaagctcccacgtaaagagtggagagtagcaatggtccgacc
cagtcccacccaccctcaacagcgacaccgcaaaatcgcgttgcagacgcgttcgagctggagggcagct
ctcgaaaccaaggatcacaacgtctgatcattattctacagagtaaacttgctgtaatcagcgcttaaac

FIG. 3V aaaccacaagatgccgagagaaatcattacgatccaggctggccaatgtggcaacagcattgggagtcag
ttctggcagcagctttgtcaagagcacggaatcaatcaagatggtaacctggaagactttgcgaccgagg
gcggcgatcggaaggacgtcttctactaccaaagcgacgacaccaggtatattcccagggcaatattgat
tgatctggaaccccgggttatcaacggcatacaaacgggtccctataaaaacatatacaacccagagaac
ttctatgtcggcaaaaatggtgtaggcgcggccaacaactggggtgatggctatcagactggcgagtcgg
ttcacgaagacattatggagatgattgatagggaagcagatggaagcgactcactcgagggctttatgat
gctgcattcgattgctggtggcacaggctcaggtctgggctcattcctcttggaaaggctaaatgaccga
tttcccaagaagatcatacaaacgtattcggtatttccggatacccagaatgccggagacgtcgtcgtcc
atccctacaacagcatcctagccatgaggagattgacacagaatgccgactcggtggtggtgctggataa
cggcgctctctcacatattgcagccgatagactccacgtgcaagagccgtcttttcagcagacaaatcaa
ctggtctctactgttatgtctgccagcacaacgacactgcgatacccaggctacatgcacaatgacctcg
tcagcatattggcgtccttgatccctacgcccaaatgccacttcttgatgacatcatatactcctttac
gggagatcaagtcgagcaggcaaagacggtgcgcaagacgacagttttggatgtcatgcgcaggttactg
cagcccaagaaccgcatggtttcaacgatacccgggaagaagagttgttacatttcaattctcaatgtga
ttcaaggcgaagttgatccaaccgatgttcacaagtctttgctgcgcattcgtgaaaggaggttggcaac
ttttattccttggggaccggcgagtatccaggttgctttgaccaaaaggagcccatacataccaatgagc
caccgtgtcagcggtctcatgttagccaaccacaccagcattgctacagtaaggaacacttttgttgtat
ttttgatcacagaattcatactgaccaagtgcgcccttaatgttctgcagcttttcaaaaggatcgtaag
gcaatacgacgggatgcgcaagcgcaacgcattcatagaaggctacaagaagacacagccattctcggaa
aaccttgatgagtttgacgaagcgcggcaagtggtcagcgaccttatcgcagagtacgaagctgccgaag
atgccaactatttaaacccggatgccggtgagcctggcacctcggccgagacggatcggagaatggggtg
aatacgtcttctagctgcgcgtctcgttcacttgttgcaatttcaataccctgtcggcgttctggatgtt
gtcgttctatgggatacatggtttgcgaaggaaaattggtggttatcaagtcaatcttagaggccaacac
attcgactctagacaattatgactgaaaatgaatgataatttcctcttgttcatctcaaaccccgggcga
tatttccagcgcttttgaaaccattcgagattcattgcaggggcgggcaaaaagctgtaagtcataatca
catggttttcattgccttgcgaggtcttgttctcgagcttcaggtgatgcaagtcattggctgtgattgc
gactgattatattgtacaaattcgaaccccatacatccaacatcctatttcgacgcatccttgggcgtct
ccgacagcccttccttcccttgccttccaataccgctcatgtcaacgcccgcgccgacggtggcgggttc
acgcagccccg

SEQ ID NO 462 (underlined sequence); SEQ ID NO 488 (complete sequence)
<MGG02952.5;DNA;Magnaporthe grisea>
gagaatgcatagcgcgtgcccgcccctgtgagagagagatatcgcggtcagcaatagagatccattgtgg
tggtttttgttggtttgaaagtgagataaagggaaggggcacagactcaagcccgccgggtgtcccatat
tgacgtcttagtgtgttgatttaagggagatgagttgtaaaggtccgcagcgtgtctcgagactgtggcc
gacgtttggtgatgtgaggctgttgatgtgcgacttttgttaaggtggactagattctgcgacagtgagt
gcgcagtagtggggcgacattacataagcggcagcaaatttcacctcgaagaggaattaggaaaccctaa
ggtggggcgcacctgctcttttcgtccctccgctgctctagaatatcaccagttctgtatttgctcctcg
tacaattctcctccttggactgctctctcttttgtgcctcactaccagcctctcgccgacacaaacacaa
gtcaacagccatggttcgcccctcatactccaagacggccaaggtgccgcgtcgtcccttcgaggccgct
cgattggactctgagctgaagctcgtcggcgagttcggtctcaagaacaagcgtgaggtctggcgtgtcc
agctcactctgtccaagattcgtcgtgctgcccgtcagcttcttaccctcgacgagaaggaccccaagcg
cctgttcgagggtaacgccttgattcgccgtctggtgcgtgtcggtgttcttgacgagtcgcgcatgaag
ctcgattacgttcttgccctcaaggtcgaggacttcctggagcgccgtctccagacctgcgtctacaagc
ttggtctcgccaagtccatccaccacgcccgtgtcctcattcgccagcgccacatccgcgtcggcaagca
gatcgtcaacgtcccctcgttcgtcgtccgtctcgactcccagaagcacatcgacttcgcccttacctcg
ccatttggcggtggccgtcccggccgtgtccgcagaaagaaggccaagtccgccgagggtggtgaggacg
ccggcgatgatgaggacgaggagtaaatttctcgttctgtttctcgtcattatgcactggctgggttatg
aagggtttcatcaaaaaatgtctttttttcggcggtcatgggaaaaatcggagtctaaagtcactgattca
cggcgttttgggccacggcatgtggtatgaattcacgtaacggagccttttgatgctcccaaatacaaag
aaatccttgacctcgtctgttaatgtccccgtgatgtcttgaagcgaaagtggacctcgacttcgtgtgc
tggtcagactttctcggagcgcacacggccaattttattataaacgtctataggggtagggttactcggt
aagcggcggccgacacaatgagttgctggcattattatggggccaattgtcacttcgctctatgttgaaa

FIG. 3W tgttctacatacaagtgtcacgcgactcgcgagggtaagagacaagttgaaattgagctctcggtagcaa
tcagaacatctcagcttttgccacaagccacctccc

SEQ ID NO 464 (underlined sequence); SEQ ID NO 489 (complete sequence)
<MGG04095.5;DNA;Magnaporthe grisea>
gatgactaagctcggaagatgtccggcagaacattgctgtggctcatctctggaatctacttgcatcata
cccccgtcccgtgcccaggcagctggcgtcggacctaccagatgacatcgccgtcattcccacccaacta
tcacctcaatctttggcgacgaaacattcccgagcaccgcgttgcggctcgcacttattacaataccact
cgaagttatcgttggctctatcccttgacgaccttttaattgacgactacgtaacgagagtcctgcgtcg
actcataccccgccaacaacccggcttatcaagttccgcgcggggcgagataggacagccgtgacgcaag
cctacggccgcgttcaggtccgaaacgaaccagacgatagacgactttgacctacggaacggggctcata
caccacgtacaccaggcgggcggccgagttggactctatacaaccacgttggcctttacttacacaacaa
gcaattaatcatgtcgggcgtatggggatggtttggcggaaacgccgcgcaacggcgaaaggacacgccc
aagaatgccatcttggggctgcgatcacaactcgacatgcttcagaagcgtgaaaagcacctgcaaaatc
agatttccgaacaggatgcgatcgcgaggaagaacatttcaacaaacaagaatgccgccaaggccgcgtt
gaagaggaagaagacacatgagcacagtcttgaccaaacgctctcgcagatcggcacccttgagcagcag
ataaacgctatcgagtctgcaaacatcaacatggaaaccctcgaggccatgaagaaggcaggcaaggcca
tggaggacatacacggaaagcttacggtagagaaggtcgatgagaccatggacaagttacgggagcagaa
tgctctcagcgaggagattgtcaacgccatcacaaacaatcagctcggaaacgaggcaatcgacgatgcc
gacctggaggatgagctggaagcgatggaacaagagcaactggacgagaaaattctcaagacgggcacag
ggccggtatcggacgcaatccagcgcttaccagcagctgcgaatggagaactcaagggaaaggcaaccac
cgtggaagaagacgacgaggaggcagagctcaggaaattgcaggcagagatggccatgtgacatgcgata
tcaatctctctggggttctcgtcctcaaagcctcggtgcagcagtctgcagaggcagacattccatgtca
cttcatctcggtatctcagttcttcgcgcaatcgcttcgtctgcttcgatttcattcgccacaatcacac
ccacccattcgtctggcatccttgtcggacaccgtacatttacctattggaagtttttttgccctgttca
cagctgagggagtcttggatcggcgccatggagttttgcgactagacagtaatatcaagggttttgcatc
ccgaactggtgattgctatgcgttcggtggaatagtccagattcattcacagggcaggttgaacaaagga
ggataattgatgtcttggaaaccacaccagtcttcctcgatggacaggtggaccgatatatcagcccctg
aactatctctaagcctcgaggtcacgtggacccccaactcacaccacatcggctcaagatgaggacgacc
c

SEQ ID NO 466 (underlined sequence); SEQ ID NO 490 (complete sequence)
<Contig2.561.g35;DNA;Magnaporthe grisea>
agctcacaggcgtgccccatatgaagtagtacctaaagagcggggtttcctcgcatcgcagcggtatctt
tttatcggcaagccggcccatcatgtgtcaacgctcgtgacgactaagcttggacgggggtttaaattgg
tgtgcgtgcccaccttcgtcgacggcacatggttatagcctaccttccaggggtgataacttattctcgt
gatggctcctccccatcctcacctttcctatcgttcccctcgcggcctttgcatgttttagttgccatac
acagcaacacttttgtggtcctttacttctctatctttcgtaaataccttacctatcatttttttctgcc
caccctccctgcttctctctctatccctctctcactcacccccctctcttgcgtcctctcgttacttccgc
cttcgttctatgctccgctttcttattagtcgtcgtcttcctcgcatctccaatgcttgcgctcggcctg
gttcctcaggatggccaccatcgagccacggctaatgcacttgctgaacgacagtaagagcaatcatgat
ccaaacgaacttccgcctctacagtcgttcccgatccccaagggctcagctgtgcacgtgtcgctcccct
cgctcagcctagaaatcgaacagcgtgatgagcaatttgccgtgaagcttccggccggaccgccactaca
ccacatacctccgttctcgacgttaaattccctcgacgataatgcttcggcgcaacacatcccgcccctg
tctttggttgagtcatctgaggatacgccctcgtcccagcagatcccacctttctcgactttcgaaagtc
tcgacgatgcgcctcatcgatccggtcctccgaccagactcccaaaccccacctacgtctttgatgggcc
cgctcgaattccacaaacagccaaccagtcaatacgcgccctcctaggagattccagccctgtagagtct
tcatctcactcccttcgcaaaatactcgacgacctgccgcccgagctaggtattcatgacgatgccacaa
ccaagaagcggcatcgggctttggccggcaaggaggattttgtgcaacttccacagcctctgaagaaaca
gaagtcggcacagcaggtcatgccacctataatcaatggccttcacgaaccaccacctaacgcggctgta
tttcccccgatttcctcggtcgaattcagaaatggcgaccactcgctgagcttgagaccgctcaaagacc
tgggtcatattccagaggacaggcatgcaccggtcacgccgactgaagacaagacagcacaaccagctgt
caagaccagacgcaggaccaagcccagaaggaagtggacagaggaggagacgaatcatctgctgattgga
gttagtcggcatggggtcgggaagtggaccagtatattggaggaccctgattttcagttcaacgacagga

FIG. 3X ctgccggtgatctcaaggaccgcttccgcacctgctgccccgatgaattgaggggtcagattaaccccgg
cgccggtgcaggcaagggaagggcttctcaggcagctaccacttcgcctacttatttaacagatacccaa
gcgagaaccaagaggactctgatgcttgagaatatcctcattgggaatgattctcagccggaacacgatg
ccctgaacatgagccctgcaaacgccacggcagccagcacgagcacgtcgcctgtctcttcgtcatccca
gccccagccaaaagcatccggagatgcatcccagaaaccccgtaagagtcgagctcaccgaaaaaagctt
gaggatcttgctgagcttggaatcagcggcccattcaaaaagtcacaccgacgcgagcgaagacccttca
ccgaacaagacgacaaggaaatattggaaggaatccaccgttacgggccagcttggaccaagatacagag
ggatgaggcctttaatttgtcaagccgtcagccaaccgatctaagggaccgcgtgcgcaacaagtatcca
gatatctacgccaagatagagaagggagcgtttcagatcatcaaggagccaaacaacagtcatcgtaaca
acctcatggagcccacggtgaacactaccattgagaattcgctcacctcggtgaacaaatcaggagggtc
atctctagaagctcaactgaaccgtacaggttcaaaggaaaacctcccaaagtggtcgttgcagcactat
gcacacgacacgtccgagacgagcacaacgggccaccacgaccaaccaggatcgtcactccctgggaact
ccggggaaatggacatttcgaggctcaagttgctttttccaagccacagcaaatgcttttcgaagcacggt
ttctggaatgtttccagtcactcaacatgggtgttaccatcctcagtattgttcttatgacgctgatcta
caggcggacagtaagaagcaccagaagcgccttgccgcgccttcgcactggctgttggacaagctcagcg
gcacctacgcccccaagccctcgcccggtcctcacaagcagcgcgagtgcctgccgctcatcgtcttcat
ccgcaaccgcctcaagtacgccctcaatggccgcgagaccaaggccatcctgatgcagcgcctggtcaag
gttgacggcaaggtccgcaccgactcgacttaccccgccggcttcatggacgttgtttcgatcgagaaga
ctggcgagaacttccgtctcgtctacgacaccaagggacgcttcaccgtccaccgcatccaggccgagga
ggccgagtacaagctcggcaaggtcaagcgtgttcagctcggccgcggcgggatcccattcttggttacg
catgatgccagaaccatccgctaccccgaccctctgatcaaggtcaacgacactgtcaagatcaaccttg
acactggcaagatcaccgacttcatcaagttcgacactggcgccctcgccatggttaccgctggtaacaa
catgggtcgtgttggtgttatcacccaccgtgagcgccacgatggtggcttcaacattgtgcacttgaag
gatgccattgacaacactttcaccactcgtgagagcaacgttttcgtcatcggcactgagaagccctgga
tctccctgcccaagggcaagggtgtcaagctcaccatcgctgaggagcgtgaccgcaggcgtgcccagac
catcgccggccactaaactggtcgcgattgcactcggattggtttctgcatttggcttgggtgatatcaa
aaaagaaggtcatgggtttacattacggtcacggagtccaggatggcgctttgtttttccatagggcatg
atatgctagcttctaagtcgagagacttgttcactgattttcccctcttccagtgaggagagacgaggat
gatgaaatgtccagtttaatgaagaaccatccggatccccatctagtgttgctgtcatgtgcgtggcttg
ttgcaatcagtgcgaactcttgctatgagtggtttaagcgaagcaagctactgcgcaggttaaaatagct
cgaccgcttcagctgaggcgcctttacctaaaacaacaatcaatgttcctatctatcggcatgtagattg
gctccagaagcaagcagtaagtatgtcacaccatgaactcgacaaaatttacaaatccgcctttacccga
gaatgacagtcggttagggctcttct

SEQ ID NO 468 (underlined sequence); SEQ ID NO 491 (complete sequence)
<Contig2.887.g4;DNA;Magnaporthe grisea>
cttgtctaccaaggtttgtaggactaaagtatcaaaactgtgattctaatcgacaccctgaggcgagacc
gccccacatctcacagctgacgctagtacaaatcaggctagcgtcacagtcgcgtcgcctcgataccata
atccacttcttcagaaagaacattccgcccttccttgacagttgttgccgcctccacaccatactttgtc
aaccacgacagcgcggcgacgggtcaggtcatcgcgaaacctgtcgaaaccccacgaaaacgatctacat
acaattcctttttctttagagattctttggagactctaaacatcaccttggcgtcttctgggagcgcgcgc
gaggttgcgctgtagcgggtaaagcctgcaccgcttgctttgaaatcagcttcagcttggcctcacctgg
attgataaggctacgcctcccaatcagcaagatttagaccaaataaaaaacgaacttgcgctcgtcttta
agttttcaatatggcggaatacggcgagatggacgagtacgccgactacgaggccggcgattacgatgct
gagaacgacgacgagatcacggccgaggactgctggaacgtcatctcctcctactttgacgaaaaaggtc
tcgtttctcagcagatcgactcgtacaatgagttcaccacatcaacaatccagggtatcgttgacgaata
ctcggttcttacgctggacaacccaaatcctcccgacacttttgaaggaaaacccattcgattgcgccga
tatgaaatcatgctcggaaacattctcgtgacccagccgacggttaaggaaacagacggcaaggttagca
ctttggtgccgtacgagtgccgtgacagaaacttgacgtactcttgcccactctacgtcaagctcaccaa
gaaggtcaacgtcgcggtcgaagaggatataccgctacatgaactcaacgatgagcagcgcgaggagatg
cagaggacgaacgagcaccccactaccattcgttgggagctggacagggacaagtcacacaacccggacg
agaagatctcgggcgaaaagatggccgacatgatatacattggcaagattccagtcatggtaaagagtcg
aatctgttatctcaggagtcagcccgagtcggaactttccttctgaacgagtgtccttatgatcagggc
ggctactttatcatcaacggtagtgaaaaagtcctgatcgcccaggagcgatccgctgcaaacattgttc
aggtcttcaagaaggcccaaccaaacaaatacctttaccaggcagaaatccgcagtgccttggagaaggg

FIG. 3Y ctctcgccttgtctcaaccctgaccatgaagctgacctccaagggtgacagcacgcgtggatcatttggt
cagacgatccacctgaacttgccatacaccagtggtgatctcccgatcgccattgtcttccgtgctttgg
gagtcgtctctgatgaggacatcctgaaccacatagtgttggacaagaacgacacacaaatgctagagat
gttgaggcctagtattgaagaggctttctgtattcaagatcgagaagtcgcgctggacttcatcgccaag
cgtgtcggcaaggatggtggccactcgaacagcaggcatcttcgtctgaaggtggcacgagacattctgc
agaaggacacgctccctcatatctcccaggcagagggttgtgagactcgcaaggcctttttcttgggtta
catggtgcacaagatcttgcagtgcgctcttggtcgtcgggatgtcgatgaccgtgatcatttcggcaag
aagcgtttggacctggctggtcctctgctagccaaacttttccgtggtatcattcgcaagttgacaaacg
acatgatgggtggtctgaggcgatgcatcgacgctggcagagattttgatctcacagcctcgctcaagcc
caacactctgacaaatgggttgaaatactcgttggccacgggcaactggggagatcaaaagaaggctgct
agctccacggctggtgtctcacaagtgttgaaccgatacacttttgcttcgaccttgtcccatttgcggc
gaaccaacactcccattggaagagatggcaagcttgctaagcctcgacagctccacaacactcattgggg
tctcgtgtgtcctgctgagactcccgagggtcaggcctgtggcctggtgaagaacctgtcgttgatgtgc
atggtcagtgtaggtactccggcagagcccatctacgacttcctggtcgcgcgaggaatggacgtactcg
aggagtacgagccatcaaactcttcaagtacatcaaagattttcatcaatggcacgtgggtcggtgtagc
aaacaagattgaagagttggtagacttggtctacgatcttcgcaggaagagcagagttgaccctgaagta
tcacttattcacgacgtccgtgaaggcgagttcaggattttctcagacgccggccgtgtcatgagacctt
tgtttgttgtcaaccaaaaggatgacccacggacaggtgcccaggcgggcagtctggtgctcaccaagga
gcacgttgccaagctgcatgcagacaaggacaacaacctcagccctggagacgagggtcactacggctgg
caaggcctgaagagtgatggtgttcttgacttgatggatgctgagcaagaagagacggccatgatctgca
tgtcaccaagcgatctagataagttcagagcgctcaagtttggcggtgcaactctggacgagttggaggc
ctttgacaagaacgatatcaacagaagattgaacaccaagatcaacccgacaactcacatgtacacccac
tgcgagatccaccccagtatgcttttgggtatttgcgcaagcatcattcctttccctgatcacaaccagt
caccccgtaactgttaccaatctgccatgggtaaacaagccatgggtttcttcctcaccaactacaaccg
ccgtatggacaccatggccaacattctctattatcctcaaaagcctcttggcacaacccgatccatggag
tacctcaagttccgtgagcttcctgccggtcagaatgcaattgtagcaattgcctgctactctggataca
accaggaagattccgtcattatgaaccaaagcacaatcgatcgcggtctgttccgtagtttgttcttccg
ttcatacacagactcggagaagcgtgttggtatcaacatggttgagaagttcgaaaagccgttccgtgcg
gacacgttgaggctcaagcagggcacttacgacaagctcgaagacgacggcatcgttgctcctggtaccc
gtgtttctggcgaagacatcatcatcggcaagaccgctcctattcccgcggacaaccaggaactcggcca
gaggactgtgcagcacacgaagcgtgacgcatcgacccctctccgcagtactgaaagcggtatcgtcgac
caggtcatcgttacgaccaaccaagatggtctcaaatacgtcaaggtgcgtgtgcgaaccaccaagatcc
cgcagatcggtgacaagttcgcatccaggcacggtcaaaagggtacgattggtgtcacatacagacacga
agacatgccattcaccagggagggtattactcctgacattatcatcaacccgcacgccattccatctcgt
atgacaattgcccatttgatcgagtgtttgttgtcaaaggtcgcaacgctcaagggtatggagggtgatg
ccacccccttacagaggtgacggtggattcggtcagcaacctcttgcgtgagcatggataccaatctcg
aggctttgaggttctctatcacggccacactggtcggaagctgagagctcaagtcttctttggaccgaca
tactaccagcgtctgaggcacatggtggacgataagattcacgcccgagcacgtggtcccgtcaacatca
tgacaagacagccagtggagggtcgtgcgcgtgatggtggtctgcgtttcggagaaatggaacgtgattg
catgattgcacacggagcagcctccttcttgaaggagaggttgtttgaggtttcggatgcgttcagggcg
catatctgtggtatttgtgggctgatgacgcccattgccgatctcaccaggaaaacattcgagtgtcggc
catgtaggaacaagaccaagatcgcgcaggtgcacataccgtatgcggccaagctgcttttccaggagct
ggcgtcgatgaacattgccactagaatgtttactgagagggacaagaaagaaacgtacagctttttcggc
tttttgctgaaagtgcacaaatatcaccgtcgtggcggcaaagagcgaggtgctcagcaggtggcctggc
tacctgcaccagtgcattcccaaccccgcgacgaaatcgcgtcccgggttaacgcgtctggcaaagaatg
gaatgatgtaattttctgccgtcccagaccacacgcaacccggccggcgttcctttcatccctgcagcgg
cgtcggctcgggcttggcgcttgctttgggggcagctccaagaccaaacaacatcaacttgccatccta
atacatccatatctcgccagccgcctactgtaacaacaccggggcaggttaacccgtcaattcgatctct
gcagcctgcgacttccttaccgaggccttttgcgacaaacagaattcacaatggttcgtcggatgcaatc
gcccaccgcagcgtccacggtagcgaaggagacaccaaagctaaccattcgattcccaacagtctgctca
aagttcagcgggccgagcgtgaggcgtccaagattgtccagaaggtccgcacaaagagagtaaaggaggc
ccgcgacgaggccaagaaggagatagaagcctacaaggctgagaaggagggcgagtacaaggcatttgag
tccaagcacacccaaggcaacaagcaggccgaggaggaggccaacaaggaggccgagaccgagatcaagg
agatcaaggaggccggcaagaagcaccaggacaaggtcatcaaggatctgctcaaggccgtctttgagcc
tcaccctgtgccgccgactgctgcttgagctgtttgtttgaagaaaccagttggcgtcatgtttttgca

FIG. 3Z ccgagcttatagaaagatgaatcaagcagcatgttgcaagattgtccattgagagtagttgtagtatgca
tcaacgcttttggcttttttttttcttctttttttcgttctataaatctttacgccaacttgtatgccgct
atgaaaacattgatatacacattaatcaaacaccagacaactgcctccaaacagttaatcttggaggaat
tcccgaagtgtcgtcagcatatcatgcatctccttcccattctccgtctccacatcgacggcatcagctt
gttccctttaagctctcactcagcagctccaaagtctcatccctatccgccaggagcgtctgaatcttcct
ctttgccccgtcgtcctccgccaccaaccatgcgaggatgacgtcgatgctctgcaacacaaagagaccc
gcgtccagccggcgcgagaaccgctcgtcttcgtccag

SEQ ID NO 470 (underlined sequence); SEQ ID NO 492 (complete sequence)
<MGG05193.5;DNA;Magnaporthe grisea>
ataggtgctgagtgatgagcacaggttgtacatcttttaggccacctttgcgagtctacctacttctgtt
cgtacttgaacttggtggggcagagttgctaatccgccacaagtggccaaaaatctgtggctgaacggct
tgctcggaaccactttgggtggtagggaagctccgaccacgtacccagaccagccagcccaggtatcaat
cgaagagctaggtaatcgtcatcagtagaagcctagtagctagccctggaccttttcgactttgtacaaa
ctttcagctttctttcaaacccctacctccaaccatcttcaaccacagacatttcaccactgatcataat
aacgactacgaaaactcgcctgccgttgaaatttcgacgctgggcattgcaactacttattcccagcgca
ccaaaccccgctctcgagaactcagggtattccgacatttccaaagtccgttttgagcacgctgctcttt
cgtagacaagatgtctgccgacccatcacaggaccctcccaagaagaaggtcaacttggccgatgtatct
ggcgccgatgtcaaggaggagtcggatgtagcaaccgcaattctgaaaaagaagaagaagccgaatcagt
tgatggttgccgatgccacaaacgatgacaactccatcatcgcactctccaacagcaccatggaggcttt
acagctcttccgtggtgacaccgtccttgtgcggggaaagaagcggaaggacacagtcctgatcgtccta
gctgatgatgagctggatgacggaagcgcacgactcaaccgtgtggtgcgtcacaacctcagggtcaagc
atggagatgtcgtcactatccacccttgccctgacatcaaatatgccaaacgaattgccgttttgccgat
tgccgacaccgtagaaggcttgacaggctctctgttcgatgtcttccttgcgccctatttccgggaggcc
taccgcccagtccgccaaggcgatatttttttggttcgtggtggcatgcgtcaagtcgagttcaaggttg
ttgaggttgatcctccggagtacggtatcgtagcccaagacacggttatccactgtgagggcgagcccat
tcagcgtgatgaggaggagaacaacctcaacgaggttggctacgacgacatcggtggctgcaggaagcag
atggcacagatccgtgagatggtggagcttcctctgcgccaccctcagctattcaagtcgatcggaatca
agcctccacgcggtgtcctcctctatggacctcctgggaccggaaagacgctcatggcccgtgctgtcgc
aaacgagaccggtgctttcttcttccttatcaacggtcccgagatcatgtcaaagatggccggcgagtcc
gagtcaaacctgcgcaaggcctttgaggaggctgagaagaactcacccgcaatcatcttcattgatgaga
tcgattccattgcaccaaaacgtgagaagacaaacggcgaggttgagcgccgtgtcgtttcccagctgtt
gaccctcatggacggcatgaaggcgcgttccaacgttgtggtcatggccgcaacaaacaggcctaactct
atcgaccccgccctccgccgttttggacgtttcgatcgtgaggtcgacattggcattcctgacccgaccg
gtcgtttggagatcctccaaatccacaccaagaacatgaagcttggagatgatgtggacttggagcaaat
cgccgctgagacgcacggttacgttggttctgatgttgcggccctttgctcagaggcagccatgcaacag
attcgggagaagatggatctcatcgacctcgatgaggacaccattgatgctgaggttcttgactctctag
gtgtcaccatggagaacttccgctttgcccttggcgtctccaacccttcggctctgcgtgaggttgcagt
tgtcgaggtgcccaacgttcgctgggaggatatcggtggtctggacgaggtcaagcaggacctcagggag
caggtccagtacccagtcgaccaccccgagaagttcctcaagttcggtctctcaccatcgcgtggcgtgc
ttttctacggtcccccgggtaccggaaagaccatgttggccaaggccgttgccaacgagtgtgcagcaaa
ctttatctccgtcaagggtccagagctgctcagcatgtggtttggagagtcggaaagcaacattcgtgat
atcttcgacaaagcgcgcgctgcggcaccttgcattgttttccttgacgagcttgactcaatcgccaagg
ctcgtggaggctcggtgggtgacgccggcggtgcatcggaccgtgttgtaaaccagctgctgacggagat
ggacggtatgacttccaagaagaacgtgttcgttattggagcgaccaaccgtccggagcaattggatccc
gccctttgccgtcctggacgtcttgactcgctcatctatgtgccgcttcctgatgagctgggccgcctca
gcattctcaaggctcagctgcgcaagacgcccgtctcagatgatgtcgaccttcagtacatcgccaacaa
gacgcacggcttttctggtgccgatcttgggtttatcactcagcgtgctgtcaagatcgccatcaaggag
tccatcacggccgacatcaaccgcactaaggctcttgaggctgcaggcgaggatgtccccatggacgagg
atgccgaggaccctgtccccgagttgacgaagcgtcactttgaggaggccatgcaacaggctcgcaagtc
ggttagcgatgtcgagatccgtcgctacgaggctttcgcccagcagatgaagaatgctggcccgggcgcc
ttcttcaagttccctgaaggcgagggtgcaccggcagccagcggcggcgagacattcaacgacggtggta
acgacgatggtctgtacgactaagctctccaatctcatcttcaatacaactcaagcctctgtacactaca
cctttgcttcattcaacgggattttgacatgactgagcccggcgcggccagggaataacggtatgcactg

FIG. 3AA ggctcggccgttttgagatttgttgacttgggcaatgttcgttcgcggtcttatacgctggtttcatgat
ttctagaacaggtgcgatggaataggtagattcgctggattcgcacttgctggaggaggccacagcatag
cctcagggaatgattgaaatattactaaagaccgatttctattggagttctcaattgcaagggtttagat
ggattaatattcttggaaagcctccgggctcccctatcatgaacctgaatatccaagtccttgatcgtcc
gtcctgctgcgtgatgatgtgagaggcgatagacagcgtaaacccaaaccatatctttggtaacgccaat
cacctgtcgccttgctgagtacaaccagactgc

SEQ ID NO 472 (underlined sequence); SEQ ID NO 493 (complete sequence)
<MGG09952.5;DNA;Magnaporthe grisea>
ccaaaatgcgctgacgtctgaatgcgctgacgtctgaatgcagatagttgatataggtcacgtgatactg
ctaccccgccactaggctgccaacgagtttttcgctggtcaggcttttgggctgggattgtctttcggga
aaaaaacaacatcaaaaaaaaaaaaagctcttctaatacattccgcgttctgaagtatccgttcttttct
cgatacaaagtcttcacatagccatcacgcgcaggtatgtgttcgctcgcttcttgcttccgattgcccc
gcttccaccaggttctccgcctcaagttctttgggttgctttgtggctggtagtcttcacgctagagcaa
aacccccccaaaaatcgacatcttgtccctccttcctccaatacaccagttaactcaactgacatcgcgc
gccgcgtctcacagttttgcgacgataccacgagcgaaactagacttcttttatcctcctcacacacaaa
catcacaactatggccgaggctcagcaagtccccaccttcaagctggtgcttgtcggtgacggtggtacc
ggaaagaccaccttcgtcaaacgccacttgactggtgagttcgagaagaagtacatggccacccttggtg
tggaggttcacccgctaggcttcgagacgaactttggcaagattcaattcgatgtgtgggacaccgcagg
ccaggagaagttcggtggtctgcgtgacggttactacatcaacggccagtgcggtatcatcatgtttgac
gtcacatcccgcatcacctacaagaacgtccccaactggcaccgtgacttggttcgtgtgtgcgagaaca
tccctattgttctctgcggtaacaaggtcgacgtcaaggagcgcaaggtgaaggccaagaccatcacctt
ccacaggaagaagaacctgcagtattacgacatctcggccaagtcgaactacaacttcgagaagcctttc
ctgtggctcggccgcaagcttgttggcaaccccggtctggaattcgttgccgcccccgcccttgctcccc
ccaccgccgaggtgaccgcagagcaggcggccgcgtacgagaaagaccttgcagatgctacgcgtgcgcc
cctgcccgatgatgatgatgaagacttctgagcggtggatgactgctagccctcgcgcgaggattctaat
ggaagcgcatggtgaagctggggttttgccgttctgggtctctttgtatagaaacactgagctcaagcgg
taggctgactacttacgacgattatgggactgatgggagggaaaaggttgcacaaggactgcctctgaag
gaaaagtgagcaaagtttcggaataggattttacatattcgtgaccggcacatccactcagcatcggccc
ttacgagattcacgacacggtggtagaaatcggcgccagttactgcattgtgaacagcttaggtagacac
taaaattttcagctgactggtttctttggcggaacactttcggggattttgcatacctgaccaaacgcag
cgaccatggcttttgagggacagcagaagtataggctcgctgagttgaaagaacacaagcatgtggagta
gacaaaagcagcgagcagagtgaagagatatggtttattag

SEQ ID NO 474 (underlined sequence); SEQ ID NO 494 (complete sequence)
<MGG06910.5;DNA;Magnaporthe grisea>
aaagactccaagcgtttaagaagtttccaagaataaagaacttacataccctaaccccgcagaggtcatt
cgaaataagttgtgccccaccaacaacacagccactgacaggggcctggggtccagagtctagactaatg
aactagccacaatgtgtgttcctcgagccgtgcgacgccttggaagcttgcttgctcgaggtgtggtgtc
ctttttggcgaggggccagcaaacagctccagattattagacgagcatccaactccggactgtctatttt
ctatctaccaacttatttatctcacgcatgtagacctaccatgacaccctgaacctttgagccaaaaatc
aagaaataagtcagtctggtcaacatcacgcgggcatcacgcccctgcatttcaagaccggtgcataccg
caagctatagccgctatcgcgccaacccgtctaattctccaccgactcttggaggctgcatataaccaga
gcacgccaccatggattatgaaaacctgaaggaacagtggagcgaggttgaggatcgcgatggcgtccgc
ctcagctggaacgtctttccgagcacgcgcatggaagcgtctcgcctcgtcgtcccgatcggtgccctct
acacccctttgaaggagaagccagacactcccctgctgcagttcgagcccgtcacctgcaagcagccatg
ccgttccgtcctgaacccattctgccaggttgatgttcgtgctcgcctctggatctgcccgttttgtctc
tctcgaaaccctctgccgcctcactacaaggacatcacggccaacgccatccctccagagctgcacccat
ccaataccacaatcgagtaccgcctgtcccgcccggccccgagtccgcctatctttctctacgtggttga
tacctgccaggaggatgacagcctcaacgctctcaaggagtctctcgtcatgagcctaagcctccttcct
gagaacgccctcgtcggcctcatcacctacggcacaatgactcaagtccacgagattggctacaccgagt
gcgccaagtcgtatgtcttccgtggtagcaaggactatgcgccgaagcaggttcaggagatgcttggcct
cggccagatgcccgtccgcccgggcatgcagccccagccgggacgcccgatgcctatgggacccgcctct
aggttcttgatgccggtttcccagtgcgagttccaacttaccaaggccttggagcagctccagaaggacc
catggccagttgccaacgataggcgaccgctgcgttgcactggcgtagccttgagcgtcgctgttggtct

FIG. 3BB tcttgagtcttccttccagaactctggtggccgcatcatgctttttgctgccggtcctgccactgagggc
cccggtatggttgtcagctccgagctcagggaacccatgcggtcgcatcacgacattgaccgtgacaaca
tcaagtactacaagaaggctctcaagttctacgacactctggccaagcggaccgcccataacgggcacat
aatagatatctttgctggttgccttgaccaggtcggtcttctggagatgaaaggtctcagcaactccaca
ggtggtcatatgatttggtcgatagctttacgtcgtccatgttcaagcagtcgttcgtgagggtattcg
aaaaggatggagacgacaacctgctcatgggtttcaacggtatcttggaggtcctgaccaccaaggagct
caaggttacaggtctgattggtcacgccgtctcgatgaacaagaagtcgacctctgtcggtgagaccgag
tgcggtattggcaacacgtgctcgtggaagatgtgcggtattgacccaacatcaagctacggcatctact
tcgaggttgcacaaggtggcccgtcacacgcccaaccagctcagaaagggatgatgcaatttctcacata
ttaccagcactcatctggacagttccacctgagggtcacaaccattgcccggaacataggcggtcccgcc
ggagatccggcgattgcacagtcttttgaccaggaggctgccgcagtgctcatgtcgaggatcgcagttt
tcaaggcggaagtagacgacggaccagatgttctgcgctgggtcgacaggatgcttatcagtctctgctc
aaggtttgccgactacaggaaagacgacccgtcatctttcaggctcgagaagaactttactctttacccg
cagttcatgttccacctgaggaggagtcagttcttgcaggtcttcaacaactcgcccgacgaaactgcct
tctaccgacatgtcctcaaccacgaggacgtgagcaattccctcatcatgatccagcccacgctggatac
atacacgtttgaccaggaaggtggacagcctgtgctgctcgactcagcctcgatccagcccacgcacatt
ctgctgcttgacaccttcttccacattctcattttccacggcgagaccatcgcacagtggaagaaggccg
gataccaggaccaggagggatacgagaactttgcccagctgctgcaacagccaaaggaggatgccatgga
gctcattacggaccgattccccttgcctcgtttcatcgtgtgtgacgcaggtggatcgcaggcacgtttc
ctgctctcaaagctgaatccctcgacaacgcacaccaccggcgcatacggtggcgtgggtgcacaaacgg
cacagaccatctttacagatgacgtttcgctgcagacttttatggaccacctcatgaagttggctgttag
tggcaccaactagtagtcggatcaagcaggtaacttgtaagcagtgatgcgatagggtcccaggagaaag
ggagtggacaaagcgatgatgactatgtgttagttctttttgtggaattttcaaaatggacagcgccgtt
ggctttaccgagtagacgggggctacagtgccgcaaattttatacaactgatgaatccttccatggtagc
tagccgtcattggtgtgagtatggtgaggacgggctcaactttgagattgaatggcggagcgagtgggtc
atgtccctttgggcaggccattgcaagcgttggaaagcctcccagccgcttgcaacactcttaacgttcc
aagattaaaagtatttataaacgggctctctgacatcttcaccagcgtcatcgtcatagacgatttcgtc
attatggtgttggttattcgtttcacccgttacaaatcagcatggtaaaggtcaatggttatggtaatga
ttaattctgcttgcgcgtggtgt

SEQ ID NO 476 (underlined sequence); SEQ ID NO 495 (complete sequence)
<Contig2.1499.g3;DNA;Magnaporthe grisea>
gggacgagtcctcggcaggttgtcagctcgattatttactaacttgaccttgaatggcaggcgagcgagg
caatgagatggctgaagttttgaaggatttccccgagcttgagattgaggtcgagggccgcaaagagccg
atcatgaagcgtaccacccttatcgccaacacatcgaacatgcccgtggccgcgcgtgaggcctcaattt
acacgggaattacagtagccgagtacttccgtgaccagggcatgaacgttgccatgatggcggactcttc
atcccgttgggctgaggctctccgtgagatctcgggtcgtcttggtgagatgcctgctgatcagggtttc
cctgcttacctgtctgccaagcttgcttccttctacgagcgtgctggaaaggtcaacgccttgggctcac
ctgagcgcggtggaagtgtcagcattgtcggtgccgtcagcccgcccggtggtgatttctcggatcctgt
gactacatcgaccctgtccattgtccaggtcttctggggtctcgacaagaaactggcacagcgcaagcac
ttcccgtccatcaacacttccctttcgtacagcaagtacacgatgatattggagaagtggtacgagaagg
agcaccccgacttcccacgtctgcgtgaccaggtcaggcagctgctgtcagactcggaggagctggacca
ggtcgtgcagcttgtcggcaagtcggcgctttcggaccccgacaagatcacacttgacatggccacgctg
ctcaaggaggactttttgcagcagaacggctacagtgactacgaccagttctgtcccatctggaagacag
agtggatgatgcgcctgatgatgggtttccacgacgaggcgcagaaggcgattgcacaaggccaaagctg
gagcaaggtgcgcgaggctacccaggacctgcaggccaagctcaagagcctcaagttcgaggtaccgacc
gacggcgaagaggttatttgcaagaagtatgaggccatccgcaacgaaatgctggaaaagtttgcatctg
tcatggacgagtaaggtagagagatatcggaccttgtctagtttgttgttaagttgcacaagcggaatgg
aagagatagtgtgcgtatatagaagtaccaagatacatttttttacttatcggctctgcgatgatgtac
ttgatcatgagcttccccaagacgtgtataagactgactgaaatgcaactcgaccgcattttgatgcatg
aaagtctgtcggaacttattcagttcaatgtgatcaaatgagcagtagggcgatcagtcaaatttgcttt
attgcaagtcggtattttgctatcagccatgtgacagttaaatatattacctaaaccgcaacaaccgcta
atttgaccgttatccgcacagttgcaaggaacatggctcaaggttcccttgtgtatgatggtagacttga
caacaacaccgcattggtaattaaacatataatgcaaagaagaaaggaagcagaggaagaagaaaggtta
acagaaaaagaaaaacaatacgag

FIG. 3CC

SEQ ID NO 478 (underlined sequence); SEQ ID NO 496 (complete sequence)
<MGG04829.5;DNA;Magnaporthe grisea>
gattacaatccccacaatgaacaaacagcccggctcatccgtctgtcaataaaattccaactcaatgtgt
tggatagagagaaaacggcgtcagagtttagcagtcttattccaattcggcagcggactgagacccgact
gcatgtcccgttgcctatcaccaccgctgagtcggggctgggaagaagggagtcgtcattggggaagcta
acaagccacaggttggagctcaaagtgggtcgccgaggccccaccttcgctcgaccagtggactcgttat
ccaacgcaccctggacggacagacagaaagcccaaggactgtccacgtgacgtgaagttgagggcagtt
tgaacgtgcgcgaaaaaaccggggcaatttttcgaccgcacacaagaggtaatttctcatagccatcgaa
acaactgaagtttgccctgcagagcaaccttcacgtcgccatccaagtttctcccctccgaccacgaaga
cgccgtcaagatgaagtacatccactcagaggagctcctggaggtgccggagggagtcaagatcagcatc
aagtccaggctgattactgttgagggcccccgaggaaagctcactaagagccttaaccacatcgccgtca
ccttctcgcaacccagcaagaacgttatcggcatcgagattcaccacggcaagcgcaaggatgtcgccac
cctccgtaccgtccgcaccctgatcaacaacttgatcattggtgtcaccaagggctacaagtacaagatg
cgttacgtctacgcccatttccccatcaacgtcaacgttgagaagaacaacgagactggcaacgccgagg
tcgagatccgaaacttcatcggcgagaagctcgtccgcagggtcgccatgcagcctggtgttgaggttga
gatctcaaaggcccagaaggatgagctcatcctgtccggtaactctgtcgaggctgtctcgcaaagcgcc
gccgatatccagcagatctgcaaagtacggaacaaggatatccgtaagttcttggatggtatgtacgtct
cggagaagggcaacatcgaggagattgctgcataaatgggggtgcgagtcgactgctttctttgtgcttt
cctctgggtctaaaggagtggcaatgggttcatcaacggagttgcatgttatgcgatggataaagtctca
tagtaaatgtgagcaaaaagatctttttttcggccacaactgtgcgacgcccgctcgcgacgcatcgttt
tctagggcatctgagcataacgagataccacccatgaatgagcctaggtacggacttggtgaccgtgact
aaggattcacgggggcttgaactagcagagcattggttctatgccgactggatggggcgcaacgctttac
gattaatgtacaaccgattttcacttttgatgaagagaatggcttgtggaaattattcgtcgttgccatc
atgagtcctcgccccatggctttctgtgtcatataggatctggctttgtcaaataggattcccatcctgt
ccccatctttttgaagccccaaagcctctgccaataaataagata

SEQ ID NO 480 (underlined sequence); SEQ ID NO 497 (complete sequence)
<MG05858.4;DNA;Magnaporthe grisea>
gtcgcaaggaatgctttgtggagtgaggctgaagtgagtagtatatggaatgaatgacctcgttaacgaa
ttgaaaaggcggcgggatgatggaattggcggctgcgcgtggagaagcagttgctatcggagcgagcttc
tgatgcgatactgccacgctagctctgtttgggcaggtggtgaagatccggcacgtgctgattagaagct
cgagcagataacagcccacccttgctccagctcccgcctcgaagaagctcaggttgaatttaggctttgg
tccgtgctccacttccaggctgcgtaggagctgcgtcaactggacattgcccgccatcttgaatgtgcga
cctgacaaacacgatttcaaaccaccacttcatccgccactcccatcgcaaacagcgcgatcgcaattat
ttacgcccccaaccgacagtccgatctagcgaagagtccgtgaatccaaacaacagctgcgttgtgccct
cgcagccaagatggaacgcttccgaagtatgatgaacggtatgggcggccagcttggcgctgcccccgga
acgttgatcgacaacgccgagaccgtctatatttcttcccttgccctcctaaagatgctgcggcacggcc
gcgccggtgtgcccatggaagtcatgggacttatgctgggcgagtttgtcgatgacttcacagtacgcgt
cgttgatgtttttgccatgccacaaagcggtactggagtcagtgtcgaggcagtcgacccggtgttccag
atgaagatgatggatatgttgcggcaaacaggaaggcccgagtccgtcgtgggctggtaccactcacatc
ccggtttcggctgctggttgtcgtcggtggatatcaacactcagcagagtttcgagcagctcacaccacg
tgccgtcgctgtggtcgttgacccgattcagtccgtcaaaggaaaggttgtcatagacgctttccgtctc
atcaacccgcaatctctcatgctcggacaggagccccgccaaagcacatccaaccttggccacctcaaca
aaccctcgattcaagcattgatccacggtctgaaccgccactactactcgataaacatcaactaccgcaa
gacagcgctcgaggagaacatgttgatgaaccttcacaagcaagtatggaccgagtccctgcagatggat
gatttccgtacccaaggacagaacaacaaggagcgcttggaccggctggtcagcttgtcagaaggttacg
agaagcgcgtgaaggaggagacggagcttaccaaggaccagctgaagacgcgctacgtcggaaagctaga
cccgaagaagcatttggaggatgttggtcagcagctcatcgaggacaacattgtcgccgtatcaaggcag
atgattgacaaggaggctgcggtgctggagaagaaggcgtctgctgttggagcaagcggcaaggggcgtt
cagaggacgatcaaatggatgtcgaggaagacctatgagttcccttgggattaccagcttctttgacagg
catcaagacgtttgctaggcaaattagaggcgcacacaaaaggatgccaaccatctcgatatgcgagcta
tcagggccgcctgagcggcagatacgacgtccaattatgacggcatgtactagtagggtgggcggcgttt
ggttggtttagacacagcctattagatagcgccagcatatcgcgatgcgcaccgaacatgttccggtcag
tcccggaaacacctctttcaccttcatgaatcatgccctaggtgcactgaaatatgcagtgccagtgcta
tgtcggattcattggcttggcagccacaaagatttacagaagttccgtctttgtctggatgttggcaagt

FIG. 3DD gacaacacaaaggcgtagtatgcgggttctttgatgacctcgagccaatgtacaaggccattgtctcatt
gtgggcggtcaaagacgaatggagcataaaataagggatttggtcctc

SEQ ID NO 482 (underlined sequence); SEQ ID NO 498 (complete sequence)
<Contig2.1053.g5;DNA;Magnaporthe grisea>
atccgcagtagttccgtttgtacccaacatgatctcaacctcgggtatcttcgccgaggataagctgtct
ggcttgacatgctcgaaaacggcgacgctgctttccatataaaagccctcttctgcatcatcgggaggta
tcccttcagttgagtcattcccccttcgttctcgtgttcctcgggttgcgtgccttcgaggtcgaggcc
gggcggatcgtgcctatcctcggtcaccaattcgtcgccgtcgaaatctattcccccctaggtcttgctcc
tccaaatcggtatggtcgcctccgctttccatgtggcttatctcattgagttcaatttcgccatcgatat
ggcccggatgggcagtggtgagcaagtccacagacatagcggtgcacagccgtacacgtcaaatccctag
tgcgggaggcaaataattcgcgttttgcacgataaccaaagcaatgaacagtattcggtactaggccgta
tctgtccctaatgggtatcgttgggctcgttactgccgacagaggccagatgggtgcaaacaagtcggct
cagttgaatacagttcaggaactgtgcagactcggacgtggtctggcctttattggcagatggctggtag
gggagttgctccgcggtgatagaactgcccccctttggtatgcaagccgcatattgaattcgcggcctct
cgttcgcgatagtctgtccatttcatattcccgagcaccaatcagcaagacatatacagacaaccccaag
acaactgcgaaaatggtggtcctcgcagcttcaatctgcactcgcggcggcaaggctgtcctgtcgaggc
agttccgcgagatgccccggtcgaggatagaagctttgctcgcctcgttcccaaagcttgccgacagtgg
tacccagcacacgaccgttgagcaggacaatgttcgattcgtctaccagcccctcgacgagctctacatg
gttctcatcacgaaccgtcagtccaacatccttcaggatatcgactccctgcacctttttcgcacaggttg
tgaccagcacttgcaagagcttggacgagcgggagattctcaagaatgcctacgaactccttagcgcctt
tgacgagctggttactctgggctacagggagaacttgaccattagccagatcaagaccttcctcgagatg
gagagtcacgaggagcgcatccaggagattattgcgaggaacaaggaactcgaggccacggaggagcgca
agaggaaggccaagcagctggagatgcagcgtaaagagtctgctcgcagtggtaggcccggcggcgcaca
gagagcaccagtctacccgacatatacacctccgtctcgccctgcagtcacagacacctatgacacgtac
gaggctgagaagaacaagtcaaaattcactgcaccaaagggcaagggcatgcagcttggcaagaaatcca
agacgacggatatgttcgagcgggtgcgcggagatatgggcaacgagatcgacgatacgccgcttgttgc
tcccacagcttccgccgcacccctcgcttcggagccgccgcgccggcaatctgttggcacggaccgcgat
tctatccatatcaccgtatcagagaatattactgccaagatctcaagggaaggcacactaaattcgctgg
gtgtcaagggtgacttgaacctgcgggtatcggacccgacgatgaccaagatcaaactgcagcttgtggc
caacccgacgcacggtgcccaattccggacacatcctaacgtagaccgcaacctttttcaacagctctaag
gtcatccaaatgagcaaggctgataggggcttccccgtcaacaactcagtcggtgtgctgaggtggatgg
cgacgccgaaggcagacgacactagtgcgcttccgatcagcttcaccgtctgggtcaacaagggctctga
tggaaactgcacattaacggtcgagtacgaactcactggaggagacgagctcagggacgtcagcgtctcc
atcccatactcgagcacagagccgacggtgtcgagctttgatgccacgtatgaggtgtccggagacaacc
ttgagtgggcgattggcacggtcaatgaggagaatgccaatggctcatttgagtttgaggcaatggccga
cgatgaaaacgagtttttcccgatgcaggtccggttctccaagacgaccccatttgttgacgtggatatt
tcgtcggtgacgctccttgaaatgaacgaggaagtcactttctcaaaagacgtgaggtgtactgccgaca
cttacttgatcgaatagtcggatggttttggcctgggtgtgtgtttttggaggccggcgcttggagtctt
aagaattggtcgacaaaaaggcacaaccggtttatcggcctgtccagatagaggtagcaagataacataa
accttggattacgtatggcgccttgagagaactaaggtttatgtgtcctttcaatcccatgttatgatct
gtcctggaaggttaggcctgcatattgtggctcgctgcagactgcggcaaagctctcctcctgagatttt
gcggcaccaagagaaaacaacaagctaacaggattctacacggccagacacgggatgctactcaacaaca
atctagctttcgaccgccatttcaaaacattccgaagacgtcgtcttggatccctgcccttcctctttac
caacggcacgatgctatcgggttgctgccgtcattaccgccatcacataccatagctccccacaactcgg
gatcgccataaatataagccctgatga

SEQ ID NO 484 (underlined sequence); SEQ ID NO 499 (complete sequence)
<contig2.875.g14;DNA;Magnaporthe griseae>
Gccaatgagctcttcgcctgggtctgttttctctttttttactacattttcgagcagtttaacgcaacatg
gaacggtttgtgatggacggggaaaggggtctgatatctcttttttattctccctcatcataccagggac
ggcattgaaaaaaaggaaggggggaacaaaatgcaatgatgtccaagctgtacatgaggtttttttatatgc
tcaaatgtggtctggttacgtcggtttcacctggccgtggcgtgtatgaggaaacgatctgggtacagcg
tggcttgactgaatgttatagcaccttgacagcttcgtgtgaatgtgaattgcgttggaaccagatgttt

FIG. 3EE gaattagtttgtgagcatcagggggctgtggggttctttatatttgcctacgggtgaaacttttcaccag
agttatctcctgccacagcaagtccccaggtcacagtcactgctattacttgaatgctttctggcagata
tgaacactatatgccagggtacgactctcgttgtctccacgtagatatgagaattcaagagttccccgag
atcggccattcatctcttaaacgatctccagcagggacatgtcgtcaagctcccagtgcatttctgcagg
gtggaagagctgttgcgaagacgactggatcagaaggacaatttacagagattgctagagtggtgattgc
aatcatgtcattaccggcaatgaggcaggcggcttcgagggcgctgaggatgcgtgggcccgtgggccgg
cacgtcaggatggtgtcgacggcttcgcatgagagccagcagaggctgctctcctcgcacctgcaaaccg
cagacccggccatgtacgatattgtcgagaaggagaagcagaggcagaagcactacatcaacctcattcc
gtcggaaaacttcacatcccaggccgtgctggatgctttaggaagcccgatgcagaacaagtattccgag
ggttaccccgggggcgaggtattacggcggtaacgagttcatcgatcaatccgagaggctatgccagcaaa
gagcattggagacttttggtttggatgacaagcagtggggagtgaacgtgcaagctctctctggcgcccc
cgccaacttgtacgtatactcggccctcatgggcgtccacgaccgcatgatgggtctagacctgcctcac
ggcggccatctttcccacggataccagacgccgaccaagaagatctcgttcatctcaaagtactttgaga
cggtcccctaccggctggacgagtcgaccggctacatagactacgacaagctggaggagctggcacacat
ctaccgtcccaagatcatcgttgcgggcacctcggcctacagtcggtttatcgactacaagcgcatgcgt
gagatctgcgacaaggtcaacgcatacatgctggccgacatggcacacatctcgggtatggtcgcggcca
aggtcatcccgggacctttggctacgccgacattgtgaccacgaccacccacaagtctctgagggggccc
tcgcggtgccatgatcttcttcaggaagggcgtgcgttcgacgaaccccaagaccaaggctgaggtcatg
tacgaccttgagaaccccatcaaccagtccgtcttccccggtcaccagggcggacctcacaaccacacca
ttgcggccctggccgtggcgctcaagcaggcgcagatgcccgagttccgcgcgtaccaggagcaggtcct
cgtcaacgccaaggcttttgcccgccgtctgggtgaggccaagggcaacggcggcggtctgggatacaag
atcgtctcgggcggcacggagt

SEQ ID NO 2 <MG00170.4;PROTEIN;Magnaporthe grisea>
MDTLVARYSRPAYQQNETFTEDDQQDLCDSVPSLSLKFAVPPVAHPSSWLRTATDDHANPNCPIKIAHGT
TTLAFRFQGGIIVATDSRATAGNWIASQTVKKVIEINSCLLGTMAGGAADCQYWLAWLGMQCRLHELRHK
RRISVAAASKILANLVYQYKGMGLSMGTMCAGVTKEEGPALYYIDSDGTRLAGNLFCVGSGQTFAYGVLD
AEYKYDLSDEDALELGRRSILAATHRDAYSGGFINLYHVKEDGWVKHGFNDTNPIFWKTKLEKGEFTNVT
SALD*

SEQ ID NO 4 <MG00884.4;PROTEIN;Magnaporthe grisea>
MKDETSRKTKGKKLKEGDEEMTVVVPPSKSSKQSPPTRSDEDVDMDESGKVDDAEVKVDPAVQAVADIKS
NFALLDKAVALFDARFTLRALRSISSIRKRLTADILAQAIAETFPPTAASGDAVKQLLASIGKQDVQLGR
QSGSEMEIDGEVKGQSKTSSSKKESKEIIPEIDIFMGILTQVFLYDSKQLERGAEFSQHLCERIHSLNRR
TLDSLSAKVYFYYSLFFEKLAPLPPSPQSPSVSIRPTLLAALRTAVLRKDIDTQASVIVLLLRNYLATSH
INQADLLVSHTQFPENAANNQVARYLYYLGRIRAIQLRYTEAHEHLTAATRKAPSSNCAVGFSQTATKLL
LVVELLMGDIPDRATFRQPTLEEALHPYFLLVQAVRVGNLDNFETTIADHADTFRKDGTYTLILRLRQNV
IRTGIRMMSLSYSRISLRDICIRLHLGSEESAEYIVAKAIRDGVIEATLDREHGYMRSKEVGDVYATREP
GEAFHDRIRACLALHDESVKAMRFPMNQHRLELKNAQEARERERMAKEIQDGDLDEDDLGGEFEGM*

SEQ ID NO 6 <MG07031.4;PROTEIN;Magnaporthe grisea>
MGSLIGSFSWVSPTKVVPAGGSGASQNTLNMEVLLGITGKDFTLIAASKAAMRGATVLKASDDKTRPLNK
HTMIAFSGEPGDTIQFAEYIMANAKLYSMRNETDLSPSALAHYVRGELASSLRSRKPYTVNLLLGGVDPI
THKPSLYWLDYLAALAPVPYAAHGYAQYYCLSILDKHHHPDITLHQGIKILTMCTDELKRRLPIDFKGMV
VKAVTKDGIRDIEFDDDKIVKSA*

SEQ ID NO 8 <MG04484.4;PROTEIN;Magnaporthe grisea>
MGIDLKKHHVRSTHRKAPKSDNVYLKLLVKLYRFLARRTDSSFNKVVLRRLFMSRTNRPPVSLSRIAGNL
KNGNEKKTVVVVGTVTDDNRLVECPKAQVAALRFTATARARIVAAGGQAITLDQLALEKPTGANTLLLRG
PKNAREAVKHFGFGPHKHKKPYVQSKGRKFEKARGRRRSRGFKV*

SEQ ID NO 10 <MG02946.4;PROTEIN;Magnaporthe grisea>
MATNGDAAPPAPAAETAAATAAAAQLDGLRPPEGVIIPPPGEIREVIEKTAGYVARGGLGIEQRLRENHS
GNPKFSFVTSQSDAYNPYYEWRKAEYKAGRGTALAAGRADAAALAAAKLAEQNKEPQGPPKPPDFEFSAR

FIG. 3FF

MPRMNQKDLEILRVTALFVARNGRQFQTQLMQRETKNPQFQFLIPNHTFHNFFQHMVDQYAIILKESGMG
GDGSKAQEQRIEQLRRNVEDRFHILERAKQRAEYAVWQEQERQKQEAAEEKKKDDFARIDWNDFVVVETI
DFTEADANITLPPPTTLNDIQYASLEEKQNFSVNAKRIEEAFPFDDTSYNAYPVQQQQSQPAQQDSPAGA
PAQPAHMQQDPEETRRIQEREQARARMHQAQADARGGTAPMKIKENYVPKAAARGPRTGGQTALCPRCNQ
QILLSEWEEHMRIELLDPRWKEQKAKAESRYATTNISTADVANNLKRLASQRIDVFDSVTGQPLSEEEMA
RRKKAAINSYDGNPDGKSQAHIAHLQHVNVEEQIRAIQQKFGDKKE*

SEQ ID NO 12 <MG07472.4;PROTEIN;Magnaporthe grisea>
MHSPPRKLTAQDQEDWRIPPPISNWKNPKGFTVPLDKRLAADGRGLQDVTINDKFAQLSESLYVADRHAR
EEVKQRALMQQRLAEKEKAQKEENLRQLAQKAREERAGAGSRRRSRSGSRSSRSYSSGSDSEESDIRERE
EARKERRKEEERKLRQSRMGAERRVQVMAREQNRDISEKIALGLAKPTQSSEGMYDSRLFNQSSGFEGGI
NEDNPYDKPLFAVQDAISSIYRPRANNDDEDEAAGDAEMAKIQKASRYGEVLGRGTFSGAGDVEAREGPV
QFEKDAAGADPFNVDKFLSEVEQTASSKRGYGLQDSSNDGGRPKRARVEDDD*

SEQ ID NO 14 <MG03668.4;PROTEIN;Magnaporthe grisea>
MATSDITTVLTNSLSADANLRHAAEQQLTQAAETNFSLYLATLVTELANENAPGHIRAAAGIAVKNAFTA
REFSRQTELQQKWLQQTDDETRAKVKSLTLQTLSSTNSQAGQAAAQVIASIAGIELPRGQWADLMNILVT
NVSEGQPHQKQASLTTIGFICESQDPELRASLVDHSNAILTAVVQGARKEETNNEIRLAAITALGDSLEF
VGNNFKHEGERNYIMQVVCEATQGDDSRIQQGAFGCLNRIMALYYENMRFYMEKALFGLTILGMKSEDED
VAKLAVEFWSTVCEEEIAIEDDNAQVESADQVRPFYNFARVATNEVVPVLLTLLTKQDEDAADDEYNISR
AGYQCLQLYAQAVGGTIIPPVISFVEGNLRSDDWHNRDAAVSAFGAIMEGPDEKTLEPIVKSALQILISM
MDDSSVHVKDSTAYALGRITEACSEAIDPSQHLEPLIRSLFAGLLNTPKMAASCCWALMNLAERFAGEPG
APQNAITAYFNDSVRSLLDVTAKNDCDSAVRTAAYEVLNAFIVNAANDSLQAVATLSDVIIKRLEETIPL
QTQVVSVEDRITLEDMQTSLSTVLQAIIGRLDKEILPQGDRIMQVLLQILSTVNGKSTVPEAIFATISSL
ANAIEEEFVKYMDAFAPFLYNALGNQEEPSLCSMAIGLVSDITRSMGERSQPYCDNFMNYLLNNLRSSTL
SNQFKPAILQCFGDIANAIGGHFETYLSVVAQVLQQASTVTITVPEGSYEMFDYVVSLREGIMDAWGGIIG
AMKSANKTQALQPYVPSIFELLNHIGSDSNRSESLMRSSMGVIGDLADAYPNGELVDAFRQDWVTAIIKE
TRSNREFSSRTIETARWAREQVKRQLGGSVNVMQQT*

SEQ ID NO 16 <MG10192.4;PROTEIN;Magnaporthe grisea>
MPPPPHQKPENVLKRAHELIGVNQAPAALTLLHEHITSKRSRNVPIASLEPVMVLLVELSVEQKKGKLAK
DALYQYKNIAQNTNVGTIELVLKKFIELAAGKVTAAQQKADEVQSSIEATNSTSVDDLEATETPESILLA
TVSGEQSRDRTDRAIVTPWLKFLWEAYRTVLDILRNNARLELLYQSTAMQAFEFCLKYIRKTEFRRLCEL
LRNHVQTAAKYSTQMHAINLNDPDTLQRHLETRFQQLNVAVELELWQEAFRSVEDIHTLLNLSKRPPKNI
MMANYYEKLTRIFLVGENYLFHAAAWSRYYSLLRQSAAVVASGQGKKADNPPATPADLQKAASFVLLSAL
SIPVISTTRSRGAMVDFDEAKKNKNSRLTHLLNMSQAPTRAVLFKDAMSKSLLNQARPEIRDLYNILEVD
FHPLSICKKISPILAQIGADEDMKKYVLPLQQVILTRLFQQLSQVYETVDLEFVESLAQFPEPFQVTRAT
VEKFIMNGNKKGDLSIRMDHGTGVLSFDTDIFSSSKASHSGSAAGSAEAEGGSVQRLQRTPSEIVRSQLV
RLGRALYTTCYYVDPSFNESRVKAREAALARAKAGAEKEHREILARKDIIQKRKEEASDLQAKREKENAK
IKRMREQALLEAEQQRLAEEQKERERKRKEKEMQEIRKQEAESLIKDLKIGPNALDVSAEDLANLDTSQI
RAIKVAQLEREKNDINEKLRITGKRLDHLERAYRKEEVKKLHEDYESQKKRDLDAYSKIKEETLKESKIK
HEESVELKHRLSRLMPFYEEFRANLQERRRDEFEKRRRDAERELEKQIAQRKKEYREKKLREKRQREEEE
RQLREAEERAAKEKEEQKRREEARKEELARAKAQREAERQEMAEKAALQARREEEALERRKREKEKLASA
PPASAAPVRASESAGGPPRLNLAGAGGKPSWRDRVPSSNVGAAPSERSERPSERPAPARTGTPMERTDSN
DRAGGPPRLNLARADGAKPSWREREQAKASGGPERDLPPSRAASGRGPPMHRTDSGRGENGRDESPAPPR
DSLTASGAPGKYVPRWKRENAGN*

SEQ ID NO 18 <MG06292.4;PROTEIN;Magnaporthe grisea>
MAPGSSGANVAALLRHAVLYHLDNSAHENALFFAERLAAQDPRSPESAFLLALCHFRLGDFLSAHDASKD
DLKGAGLRSLHIGRAYIFAQSCLALERYRDGAIALERCRPQWPHKTTFGKHTASTRSLIPDAAALNCLLG
KLYQGLDDKNRAVSCFEDALKLNPFMWDAFTSLCDMGVHIKVPNIFKVTDKLVRALDSEDKPTINDKETS
SAATLEPLPRKSALRSAPADTSDPFDQPRAVAFQDRQALGNLVAAETEENEFLQKIAAARSRMAAASGPS
SASDLLDTPPAPSAPVEINALRGGAHPEPPHAPMRKTRAAHTIEPPPSDAPPRMGYRGITKRRANLDPNS
EAPSATEQPVSQMLRTSASSLLGAEQRKRTISGHPVQSRPGVTEEPGAPQRRSARLNMFKQPSTAKPNAA
AAPIGTTSTREMKKARPAISRIMRPGSSGSSVGRVVSGNRKPVEENTMDVDHVEPPKMRDAVQPPLGPAR

FIG. 3GG

TIEADGHSTVRLEETLRLLMDLLKRLGTGYLALSQYQCSEAVQAFSTIPRAHVDTPWVLAHIGRAQYEQT
KYAEAEASFKRLRTLAPNRLEDMEVYSTVLWHLKKETEASFLAHELVDIAWHSPHAWCALGNAWSLASDR
EQALRCFKRATQLDAKFAYAYTLQGHEHFVSEEYDKALTSYRHAIAADRRHYNAYYGIGRVYEKLGNYDK
AYTHFHAASVIHPTNAVLICCIGTALEKQKQVVQALQFFTKATELAPRAAQTRFMKARALLALGQLHEAQ
KELMILKDLAPDEATVHFLLGKLYKTLNDKNTAVHHFTIALSLDPKVSQPLHVNVAFLGLPNGDG*

SEQ ID NO 20 <MG07116.4;PROTEIN;Magnaporthe grisea>
MAPSQSLPDHAPSPSPNFTSRTVTRLDEENEEYDSYEDLGKTLRPLAFEFPPNRRLATHSRDSSIEKITV
QLPLSPPQTQQVAGSTSSAASPVVSPRAHASAVRSATGIGGVIERAIDPKAAAYGHHRQTSIVHGIQHSR
NGSHASSVSSPLSPQIIAAAGASLALDPPDMHAYAVSTSDIDSPLGSRPPTAASTGSTLVNSPVGTERSS
AATDTTAHAPTPRRMHSGKARRDHTQNPSHSSRHHKEEQKTVGGYAMHVLFTSFIAHAEEKLNECITPPS
EPEPQVEQICGPGADESFDRLIVALGHIARQKPKPLIDSMMLWRKSKSDAASDARKQLQMSKSVPPSGPL
LRRNTEPLQLMSGPNPQDQNGSISPSPLAAKQEYVVQTERRSSVSTYLLCRVLLEVISQSSLSLITPEME
DKLEDIIFSQLKVADPEQLIESPLKLANWNIFAQLLGVMSEINFTSVTNRFIQDLERSLQELGSRGSALP
SREETEGRIELVLGGMKHLRLALTPDDAWERSCEFMSALGRLFARSHGQKIKSSFCQVLEMLLLPIAGKA
TNSQFMKPQWAEVLSNAGPRLAQMFVKPRHWYCSFPLTATMLCVSSPETFSSQWLQLVYPLQPKLKDRFS
KPLCLQVVSRLVWTYLYRTNESPASTVRKLDEVLKLVLPTAKRTINSADPTVSEPLIQIIRIIGFKLPEF
CFKTIIFPLINADLFATNRELKVDSLEPDKVVIGIRAFLAVMADLEKGDQGRPPFPQQYPITSVPERASQ
TPIANGSSSPPTPGGPLDGVEDEGLARRVLTSTLSESVKEYYTRFCQILGKITIMCDNTFGGQAALDEKF
NSPTPKTPIADTFNFRRDEHQNPTDQKQAFYELLHVAVQALPRCLSPDIPFNSLINLLCTGTAHVQSNIA
ESSALSLKAIARQSHAQQVTMGFSRFIFNFDDRYSTMSDGGMLGAGHIENTLRLYVELLHIWIEEIRHKT
KEATGAVGDTNASDKRGMKLDLSSIWAEVDQAEAHGLFFLCSQSRRVRYFAITVLRLIKEFDMALGKAES
DDEKEAVRLIDVLEKDYVQVMTFNDDHLSVAERSRLQRGMQDNNSQGLITLCASDVSYDTTLWFKVFPHL
IRVAYDRCPFTITIGRDLICNRILQMYKAITIISEPSRGLYYGSDPGSARLTGRTPTTQPELLVEQWKLY
LVFACTTMADPGSPQQPKQPPPPQAAQHGRKGSNNKSLSADKIVTARTLFKYLNPLLSVSSASVREAVVV
AMGSININIYRTLLEELQGHVSRCNDEARARIHQRTNSSPRRNRRMDLLRTEITHVYKLTSHFLKDPSVI
QDDWILSNLVAYSKDLKLFLMDGEVQMDWEFQKLRRHYCGLVEEIFEGIKRTKDPSRWMTFEARKSAFAL
MEDWCGFSPNHNQIRHREDTMRQSVIEQQSAGERGTLTAAMEIEKRNLRTAALSAMAALCGGPISVTTES
GVSLQFDLRRMLNWIESIFTTGNDRMKVTGRRALKNLLVHNQEYPYLLEHCIMRCYLANVPKVLESYFSV
STEVLLEYPEYPASFWKLLPLCLFTLGNDQSDIRIKSARILRALEERQQPPRSSKIQDFDISISDKTKAV
YKLAQYKISERLSKQYTELAFYFFSQLSLYFKDLESGAQRNMVAVILPWIQSTELKVDPNGGPVAQSYML
LANLLEITIKASSALHNEVQALWQALATGPHPGNVRLVLDFIMALCLERREQNFVEYAKQIVVFLASSNS
NPGQKVVEFLLSFITPKNMVPNEKRDTPPPPPDVGLLPYCADLSEALPVGTKQAGFSTGQLSMILLVDLM
VSPVKVVPDNVPVLLQVVIVLWDHYTPLVHEQAREMLVHLIHELVISKLDDATPQSKKKAIEDLIDLIRQ
HDKLVIWNYEDSNGKAEDDGSNVPPSMEYLAAEVVNTFEVTYPGIKDQWARLSLIWATSCPVRHLACRSF
QVFRCIQTSVDQYMLGDMLVRLSNTIADEDPEIQTFSMEILTTLQTIIASLDVDKLLTFPQIFWTTCACL
ESINEQEFLGAVKMLNEYLDKVDMTSPSPLLYKGLRSAVCLDATLATLNRLVPLPSDPLIGDDSRVFFTI
LANLPRFLQTMDQPRPLSEPVSKTIGALLDVAIEEGHSPVALVLNGFLSGNYRNGTELVHGVFAAFKDTF
STQLDFKMITMIMGFLTNRTPWVTSKTLQILKVIISEIDMKRPDIIGHGSDLLSPLLRLLQTEYCMEALG
VLDNIMNMSGSTMDKQHLRMSMTRSTFKAIRKEYERVQSLFGIPEESGWAIPMPAKKTETTRANVHAAFY
MCQGAEGIVTDVMPTPEVEFHADEFPYGYFPTSYERTETMLSDEARGDGNGGDVVTKLDSLDDFFDDLSM
SPPSEAHSSNTITEFIPDNNYDMEAQLYDEQVLPILHQASTASSFQNGFVDRPAPLSRDGYSNTMTPGAF
SFDQELTSTTRPGLHSRSVTSPSAPASYQPHLGEAIASDDELFSDDERSNAGGAPPEGSFFLENMVKPLT
QSTRTRIRRLTGNRSKDERQHLDISRPDRPGPPQVPKLPSSYLPKGSPPGSGDML*

SEQ ID NO 22 <MG08911.4;PROTEIN;Magnaporthe grisea>
MSEAYLLETLQSFYGDLIAIGEGRLNGPSLEGDELTALLENFKNFLEEPPKRDASRKQLESGKISVGDVE
YSINKEFQEYSIQLADEVNLDEVEAAKLLLEAQDSQILLGRSLVECALIRFHQRRKYLLDCIRLCIELAN
DDENESIKAVFEEIVARYVFDLPLPGAPAAAVPKEKKVVPRCMAAMAKIKDWLEKLANKIMLARMHSGTA
PPEIETIEFCRLSLVQQHENLAVILCAAVEQRHAERTNFEEFIQLLKKADKYDHLLVHLFPVIGAYIRLY
GSTEGWGDLVIARSLNQKIVNDETSWSLPFLYAAVKVWWIAEYSGFYVEGPVSDPSIDIDKEDKERNKQF
TDALKEGAFDFMLSLAGDVAAPEWQDPSRIGIRQWLQRKSPQLMTDSTPFSDYFHTCLMNQLEDFVDAFI
SNLPDVLRKLRTEEDEQRQLSQHHEQDLDLERFLVIISYVFERRPDAADVFWSDSESNLAGFMQWASRRA
STPLVCAFCEMLQSITENEQYALAAHQFLLEDSNAGGKMRRSQSLTWAQIFKELHYFTKKIRGEISSPQQ

FIG. 3HH

IHEYRTQKPGEDLAETEPESAMLLECYLRLIARLGSQSTAAREFLLRNQDFPLVDVILQLNSCHIPPRLR
ACGFYAIAALVRRKEQDDSNTMWLCIDAFVSGGFQAASNSRGLIKGQSHSSAGVVDRVLDELSNGFEEPS
AFINLINALVAPADQASLLRDALPFPENLGSSLRMPGIEPYVDFVVGHVFSLKSKELQDVSQLRVLRVSC
LEFILLCLNTFNEDLIILGNQTNVSVDLIIATSDLATYVRLHPFARVMEWMFNGQVVDAIFETIHQQSSD
IGSVSPDSPLILGIIRAVEVVSKVLELQDTYVDLVRQVIKQHTGQRHRHVPHASYASFEEGFAHHLEVVA
DLGRYCGLGHPELTMVCLKLLARISTSSKLISAWNTEPGRQSHRNKAVVALEKDGEADSISGSLIAELIV
PLDLAREADSPNYLIKTYILDFLYACLRASPDQPTIAHLLLGFKCGVSHLKVEPRGQFEERTSLFHNLLR
VLLETPFGDEELGMRTWLVALKRKVMGILQILWSSPLSSAIVLEELRSNDVLFHILLREESIQPDLMWDG
VSMEERGFLLSDAAVGFSEFLATRQLTFDYLAIELCSVTQRRLPSLKRRIYDALNGQVTTANSDSPQSIP
TIFDLYDFMPADGQWEIPLPEFTHFKGEEFSMCLEGAHDSVLMYNMERVKQVIALKRRQDAQNGQIATAA
DLASVDREQVILEEYLVYHNRQAAVSSERRKVLKAWVNLLMVMFEASDHQGSAKVAFLLQALQTILPTLE
SFGSERPGEAFELAKLAKVLLFKLDIAAPDAEDKDAHTVGNLISEKLFQLFEVCLYAIGRRTGSAELRST
YYAICYRYLIGIIDDGRDFVPGRRKAIKAVQVYGERLLTIVCDDAFGGDATCQTSALILLGALTNLGRRE
DDGQVVEALNRLNFIGVLVDSLKTILDDVTAARKAGNSDQQESYSHAKLALLLQLCQTRDGAKYVLQANL
LRAIEVSGLFAADPELQIDRSDTKALADHYDLLIRVMRVIGAAILSRGAHNVPQGRRFLTEHRMLVMHVL
KRSAGIAAVDQKLEALVVGLADSFMVLITATEFLEFEDTQGRGPQQQKKTGPVLFH*

SEQ ID NO 24 <MG04056.4;PROTEIN;Magnaporthe grisea>
MSADPLLPIAPARVKALVLPVGQIRRQRFASFLDRLAAEQVVQLRDISPDGRPNRNMFSPLAFPDGAMFY
ELTTHYPHPSYLTLTPFDLYREPFVVIAVADASEIDRHALSKRQSGGGRTTTERNIRGLYQDLEDLRDQF
PKVLVHRLLLFDYVENPDEHVPIPEDITTIPPPQDCKRTTMRTVMCDIASQLLAEMTSMAKQFEALSYVD
SPGQIPTGQPNGQDPMHARRNSQFSLPGGTNGGRSSSAAANNRMSMPVLPKGSGFGSAGSTPIRPSTPVK
SGLSNTPNLDDGSSEFSSGPPTPEQPNAVRPGTNENFRTVSQDRISVQGFGSGGLNERWRSKGKGRVTII
LGSLYLQAGRWPDALNHLTEGATVARSINDHVWHGKALELIVICLLLLGWAGVEFQVPSVLLAPTSEKTS
ASAAAAMAADEKNASPTQPRWFRNLQVILPDLLDRIIALYSRISAEHLPPLPMAEAIIRCSRTLTGLHLT
DGCLEADTLGLLVLGRAPTKVLSSSPRLTVTPSRTLIVNMMFKAFPNSSTEMLSAVDRIAILSGIASVLG
MLGYQRKKAMVIRELVSVLIGGLVEARTRGAAEVGIHPAAGLAALNGVSGHITGAAALDLGEGDIEESID
VFLGLLLRTYGVVSFEMDTLVSPTKDMETAHTDDGAVVRIQKQAAARFFGIPALKLNILRACINFSEALP
DFNGVLKYSSDLLRTAGSGLAPGPRREDAAPIISRDEQVRLITNILKTSSLSQRLGMGEMLADFWDEFFL
RGVKLEPLPRTRATIEHKKSELAGASTARESQDVDPLIHNPFLKPPDKAAVESTLVAFEPATFKLTLQNP
YEIEVEIESVRLDTEGVEFESSVDSALIGPYRTQILRLVGIPKAAGSLKITGAIIKVRGCRERRFPIFPS
PWSPEDQPKVKAIGLAALEQHVLEPASQAPKTDHISLNVIDEQPVVVVKSTSLAQSSVMILEGESQVFSV
TLQNLSKTTAADFLLFSFQDSTQEPLQAALSKRNATPQELYEYELILARKQALRLKPRADHKRYIGPGEE
ATFDFQILGKPGLTGGIIQVDYAHLGVPPEDVPAKFHTRQVALQLTITVNASVELTRVDVLPLHEGIPRP
LLETAFRRGDGASSLKEIQEKVSSDDYCLLLLDLRNAWPSYMQVELSTEDGALIEETILPGYTSRVMVLL
KRVYLEDPHAAVPTLNPARQRQFVVSTTISPETERANREAFWYREELLNRIKGSWRATSGTNRHGAIELR
SIRLSPRMIDAVKIEDVDIDISVASQNPGDDESKNVLYVDEFSRLNVHIINRSAKPIYPTLRLMPALCHR
PLNVALDYTRKFGWIGTLQKSLPLLEAHGETNVVMTVAALCRGQFEVTASVEETQLWRDEGATAKGSDEG
GRPRSDTQTLMDAVLGARERRIWHTRKPFTVTALDRDG*

SEQ ID NO 26 <MG06314.4;PROTEIN;Magnaporthe grisea>
MDNPYPEEALLDNHQLIHQDEQLGQTVFTREDFEYALRDFQEMSGGEDGGAVSEVSDADSVYLGVQEQIN
RAQADRTAFLDAFQNPQEDDDEDIYDGLPTKPPPRKKVKRGPVVRKGPPIKKAPRKAKELPTEIKVLVDA
ATNAFIANRYDEALQAARETIRLNAEVAPAWGILAAVYEEREDWRHALEAKRIQASLTKGDTQLWLGTAD
LALHMVDGAYQDSPEEIDKTLKVAMDCYRSVLQIDKTNPVARLGKADILADLGQSSKAVAAYLDYLKQKP
YNLRVVRSLAEHAYNARRAKEAIEATVLAYEACIQHFKSGQTLDDDQVLDWIDVRIFIELLASLEKYDEA
AKWLKTLVRWLVGRNDDLLWDQCQDDREWDLDDTRRLEMEGFNQGEFLPQSYGHGLPLELRGKLAVYRFR
TDMEDEAMRHLRQLDPEDADIRGKLQFTPEIAKEVADQLCESGKPERAILYYDLYRDLVGEALDAEYYVK
RAKCHVQLADGPAAEDCFIYALEVDEDNIEARYELAKMYEEAQERDEAFRLVGEALSLEAGQSVYDGLTH
RYVVDRGKIVSKPKKYRTGATKRAPTTKAKYRPRRLIGGGSGESARKKFEDEVTARLRERYTECQRLKAQ
MDANVAASGGHDTNDPVVAEWMSAAKELVDDFRSFREFYSWERYVSSLGYGNFFKAEASADGNTGDERSR
SIAKMAKRLHNTLAPVETEGEEAVPQKIERQEHRGIPFNDWLDLFLEYAISLARQQRIGEAYAVCQSARD
SIVYGKAKDSLMLIHLAWASCAVQAGDEETCVAIARYFMIHNPFVTDGYKMFAALTRVCQTSPTWYQSGP
SQKFMLRQIRQMDEILAAKAKEEEDGFGAASNQGSQPPGPSAETQMVPATAAAAQPGPTGVDAVLLVLYG
CILFASTSYQYALAYFLRARTVDPDNPAINLVIGLAYIHWALKRQSHNRQYTLMQGFSYIFKYYEDRTRG

FIG. 3II

AAAPEERQEAHYNVARTYHLLGIHDLALEYYHKVLVEARAARTEVLRGKDVSVRRREDLSLESAMNIRTY
CLSTGDLEGARAVTDEWLVLE*

SEQ ID NO 28 <MG08863.4;PROTEIN;Magnaporthe grisea>
MEQPLFRNSSSARTELFAKVGRPIISKLVMRPSAAPSQANQLLQLTDRLYSILNGQVSYDASAVDAKIAE
YVFFPLSFVFKNKEDHSARVLENAIKCLRILIQYGWRSTISTSLTQQLLILLTFIIAGVPGQQRTSPPPE
ETVLECYRSLAVLIREACLSSSVSESLVDSSGLPSLGHTVTVILDGSTDGMTADIQLAALDALRTLFVSM
KDRAALASFLPGSVSTLSKLLSPPASLKLQKRVLCYGARVFGDVLTRVLGDIHNRDALRQLTSDTTGEGK
DGELSGTELSASWLKATSAQVRMALAMVLKLRSHESDNVRNAVERLALSLLDECHASLADCTVFLVETAI
FTWKEEDDSTDLSGGPKHTASSIRDSALPESVAVQTTLQDLAMIYPELQDAIKTVVHNMITSMPRIMQTS
DEKIKQQCIFALSRGQRIVKVLNIDSSLLHEALSSALRDSIVALTSSKKQLNVVADAEFEGEMSVNPTDL
VTRPGETRTFKPIMLAHGSQAGTRDAFLRLVSGIGSPSQQADLATDMISLARDLSGIDQVTALWLAFELL
KVALAKNEQDEQFFDFSGTMSTNEPTEVFQELYQLSVLMLTSHTDSLEVDWRLEAIAIEVTTFAASQMGV
SFRPELIDTLYPIATYLGSQNTQLRLHAMTALGLIASACGYQDVSELIVDNADYMVNSVSLRLTSMDVTP
ASLQVLRMMVRLTGPKLLPFLDDTVAAIFAALDNYHGYPAFVERLFSVLSEVVQQGVKSDVLLLESKESK
SLDHRKRSMAAATINDIESEVKERIAKKQKRRKEKEDLLPGVRAKHPQKPWTSEAKQLLDERERKMKADD
EEKAEDTGSGGEVEKPKPVRTPTYELLSRVTTLTQYYLTSPTPTLRKSLLDLLSTITPSMALDEDAFLPM
VNSLWPVVISRLRDGEPFVVAAACRAIAALAQGSGDFLASRIKTEWWDSMSRWCQKAKQNAKTGATGNGG
RSGKSNNSVPIHSGRNIGRLNMALVGNEVVLPHRPQGSSRPGSGGVDTEKYSDGGLGRFAQASQVWEATV
DMLVALVSFVRLDDEVFDQILELLADELESNSVARKALEVVNADAVWLARFERGSLTQDLSVPVMDGIRF
AALA*

SEQ ID NO 30 <MG05169.4;PROTEIN;Magnaporthe grisea>
MATDAQGPGSLGNKAAASDGMPNMVMPYEPQDPAVIAEMVRVLDEHTKGGAKGRFRIKKTKFAVTGSPSK
VTVDSWKLQDWDYKKPGLPTYARGLFTTRLPNNVPEIAVRGYDKFFNVGEVPETNWENIIKNSKGPYELS
LKENGCIIFISGLHDDTLLVCSKHSTGARGDIEISHANAGEKALDKQLAKIGKTRADLARELRERNATAI
AELCDDSFEEHILAYGPDKAGLYLHGINVNQPYFMTYPGPAVNSFADDWGFKQTGLLIMDNIKEVKTFLE
DVAETGAYGGRDVEGFVIRCKLKDRPNTDPGTYSDWFFKYKFEEPYLMYRQWRECTKALIAGHAPKIRKH
KKITEEYLYYAKTRLAEDSSLAKAYNQNHGIIALRDDFLKYKNMKGSDAANLDRDVATNEPEPDNSVVGN
VILVPIATIGCGKTTIAVALRTLFPEAFGHFQNDSITQKKGRPAIFTRNVLEQLKTKRVVIADRNNAWRR
ERTQILGDVKNMLPAAKLVALHFDHDNSMEVRKLTYERVFQRGDNHQNIKVQELGKAKVMDIMNGFLDGL
EPYSAFSKPDADFSAAIGLNPLAGSRTNLEVVISKLHQFYPNLLPRVPTGEEMDKAIDTALAYDPKLEQL
AVLPAAANNNKGGIEYMSIDIPSQAVLAALEDAFKDASPEVGRMYGYLKQQRRIQPAFHVTLMHKSGAKT
SPENQELWTRYTQTLKVAHDDAKSKGIVFRAAETPSLGECDVQLERVVFDDRLMAIVVRIIDKDDKWKCI
NRVPHITIGTLDNTVPPKESNDMLALWIDGQQEARRGTIRETGIEGRPIVKGIVKAVLSKF*

SEQ ID NO 32 <MG07222.4;PROTEIN;Magnaporthe grisea>
MGEAQSPPRLSPRKKRAQKPLGNGFFGGIKETPGRAAPPLSSAAPSSSPAFATPAHTLRPFNPQKPAGAA
ILPILLPPATLRPLAFRTFTKKHSLTLTSSALQELASFVGRHCGSGWREEGLAERVLEEVAKSWKAGNGG
VIVDGASPILKDILKTLEGNMVGGKIVTGAGKGLVRQNSLLLDPSREPDYSSTTRLGLRPSIALQRDDSQ
SSMGMSGLNFEEEPEEDTLSDPRKWLKVVGAYEQPRMVYNVAKKHFERDASKPSILPTASHKTLLFRNRF
NVIHQRLLRNEAFQTSAVADTKRGSLARSTSSLSSQQSYKITPIANLLGRHGSHHMLLGMLVIMPAGNLA
VSDLTGTIALDVTQAATIPDDSSWFTPGMVVLIDGVYEEEDDHTAKGLSGSSGIGGTIGGRFQGFFIGQP
PCEKRRATLGVSGPEGDGLEHTIGGGFGWIDFLGVGSERAMGPRMRKLERRLLRQPQLSRQDMAASVLES
TLSSTLPRRGRIIILGELNLDQPRALQALRKILATYANETDNDGSENDAADETVASTKPNKTTTPLAFVL
AGSFSSQAVMARNGAGGGGGGGSAGLTGSGGGGSIEYKEYFDSLAGTLAEFPSLLRESTFVFVPGDNDGW
ASSFGAGAAVPLPRKAVPDLFTSRVRRAFATANAEGTSPRANAPGGEAVFTTNPSRMTLFGPNHEIVLFR
DDISARLRRAAVRLKGSSSTSTGPEHDNNEVRMSDDAPTAGDMEIDELPDPAVESAASKEPRPDMVPHDV
RAAQKLVKTILDQGYLAPFRTAVRPVHWDHASALHLYPLPTALVLADATAPPFCVTYEGCHVMNPGPLLV
PGRRGVARWVEYNVGHRGSVKEYGEAAMKKGQDPLTNDTNIIEAPVICQISHLGPE*

SEQ ID NO 34 <MG03872.4;PROTEIN;Magnaporthe grisea>
MGKRKSEQHRGHHGRKRRRLAAERENEAAEEAKHNIEEQPAELNIIHDDFIPLDEDTGAAGPPETREYFG
MLTEDEQEEFKRLDNALEDDDPNVDREELLATIFEVAKGKELKLACSQSCSRLMERLILLSNTRQKKGLF
DAFANHFPTLVTHRFGSHCCEQLFLQSAPVITRELTGEVEGNDKDAQEEGAGDGAEKQPLLTMEELFLLV

FIG. 3JJ

LDELEEHLTVLMTDTFGSHTLRVLLTVLSGRPLSQVATKSLLQSKRKEQIALPDGWTATEETGDQPRAVP
ACFDMAVRKIISDVLVALDPTMLAVMVKHPTGNPILQLLLELDIALNTKANSKRKSKAQEAEEAKLEAAE
EKPKEEAGAPQTLLERLLPGAPSTLSEETSEAARFVSGTIYDSIGSRLLETLVSHCPGKIFKGLWSHIIG
PRFETLLRNETATYVAMKALVRLSREDLADAVLKTIPKVEMLVSKGRFNILTLLFERCHAREASVSADAL
LKAVTEACSALGGSLVRTLCYLDDEDTNKEEKKDKVKKAEKDQGDKKDKKDKKDKKDKKEKKDRKDKPAV
SQEKEPLADPPKKKDDLIRNGTKLATTMIQIGGKPAQAVQGSLLFLDQEKLLHLATSSTATAKFLTAALS
APSSNPIYHKMLVTALKPHAMELAHSFTGSFVINAVALIPSKAEGFALPFFIKQSIVELLTADDASLRST
PQGRKVWAAWKGELWVRKRAEWIRWAKEVEPEEARWAKTPQPRVKEERPGQKGDKKDGRGPNGRQFTDKD
GKDKDKKRKKQEADE*

SEQ ID NO 36 <MG04185.4;PROTEIN;Magnaporthe grisea>
MAEKLDEDQVSGLIAILRKDVSVDAKVQQVNAVKSSIKQHNVPDNCVVPVFEALRIASTAQHAVLVNAGF
TGLNHLITRMSRQDPKYLSKEAVRLLPLLTEKLGDQKEKFRIVATQSLITMYKATPAEVERVIRNVAMVG
KNPRAKEASLHWLLQMHQEHGLQFRAYVPTLMDLLEDADAAVRDAAKTTVIELFRNAPNAAKSDLKKQLK
NFKVRPAIEQAIVKELVPASLSAAPSDSDARPASRAESTRSTRANLSASTTSAGIERPVTPGLLDSKPET
VDPTYVNTQRELDDIVKEMHLYFEGKETEQNWLQREESIKKLRRLLAGNAVSDFHDAFLGGVRGLLDGII
KAVTSLRTSLSKEGCSLVQELALAYGPGIDPMVEILMQTFIKLCAATKKISSQLANVTVDTIIAKVTYNH
RIMQHVWFACQDKNVQPRTYATGWLKTLLNKEAQQKSHIEHHGGLDLVEKCIKKGLADSNPLVREKMRVT
YWTFNEIWPARAEAIMEDLDATAKKLLQKSSGNTSSPKPAAGGARPGMGLSRSTMTASKPSLRDAMLAQK
RALASKNLPARPGSAMAHFSPVGTASSASSAAVTSTTTAKPPVRQKQLQEAPTSTGSNSLSVAPMRPGRK
RLELAARPATAGPYSVRTHDTVSLEQNSPPEKTRPKSAASKAAAPSPRASPAKPKPTAIARTLRESSPSK
PVDAPSPARTMASPMPGSPVSAPPPVLTEPTQEPETEQQETRPESRTSTSPHTPPRPVKVYEDPFTADEP
STKPNLTRPVLEDIPINEDAANLVRPVETDPVVASTDGGPPDKAKHDIPIEKVPDVKAQILATIKLLLKR
ARDNFQPHVSHALESLLEARGVYEARTHIVSGMELLADELVTIGDPSEMVVVLTQALQGVEMDARGCRSL
NMGLHVLREVVDARPDFHPTESELAALSGLAARCLESHESGVRMDAVQLCVALHARVGDTRFWDNIKGVK
EDPKSLITYYIVKRQREHDAAASNGLSAAATATVI*

SEQ ID NO 38 <MG01760.4;PROTEIN;Magnaporthe grisea>
MAVGLANGRHAAEEEARAEVDVLNSRLEKTTQLTKKIEACLVRLESTGKSVREVAGPLNGETKKLQVLDI
DNVLSAIERLRAPADSKNDEEQIIRMGPEKADLPNYLNSLKRLNKALVDMKASNLRSNQQTMNDLQRLVT
LGTTQLATLFDKLLRSETPRSLEPLHYITKDKPFPLLSRDNVNRLGPIYSFVAGSNRQGKGVGSESTIAE
VYSEVRGPYLAETLANLAAASVNTAKKKNPDAVYRAGTNGIGTYAQAMERLFQAEYENITRIFSREDWAP
LFQATCQNAIVELSRTLREINAHIKVHLNTDCFLAYEIVEIISGMSSRLEDLRAAFAACLKPVRETAKTS
LGELIEDTKRKVANMQSIPADGAPSPVIAETMQRLQIMVEFLRPVSSIMISIGNGGWKSLASSRGGGDAL
PSLASFDVGANGQEIFADYCSDTIDILLLSLDGKARMMNGKKPVVGVFIANSIAITERSIRESDLAPLME
TRLGILETYRKKAKLYYTEPCKDVSMHLFDVIHTSKSARPSSGQASADSATILKQLSSKDKESIKNKFTS
FNAAFDDMVARHKSFSMEREVRQMFARDMQQMLEPLYVRFWDRYHEVDKGKGKYVKYDKAAIAAVFASLY
*

SEQ ID NO 40 <MG00604.4;PROTEIN;Magnaporthe grisea>
MREIVHLQTGQCGNQIGAAFWQTISSEHGLDSNGVYNGTSELQLERMSVYFNEASGNKHVPRAVLVDLEP
GTMDAVRAGPFGQLFRPDNFVFGQSGAGNNWAKGHYTEGAELVDQVLDVVRREAEGCDCLQGFQITHSLG
GGTGAGMGTLLISKIREEFPDRMMATFSVVPSPKVSDTVVEPYNATLSVHQLVENSDETFCIDNEALYDI
CMRTLKLSNPSYGDLNYLVSAVMSGVTTCLRFPGQLNSDLRKLAVNMVPFPRLHFFMVGFAPLTSRGAHS
FRAVTVPELTQQMFDPKNMMAASDFRNGRYLTCSAIFRGKVSMKEVEDQMRNVQNKNSSYFVEWIPNNIQ
TALCSIPPRGLKMSSTFIGNSTAIQELFKRVGEQFTAMFRRKAFLHWYTGEGMDEMEFTEAESNMNDLVS
EYQQYQDAGVDEEEEEYEEEAPLEGEE

SEQ ID NO 459 <MGG09222.5;PROTEIN;Magnaporthe grisea>
MADAAPRGGGFASRGGDRGGDRGRGDRGRGRGRGRGRRGGKSDEKEWQPVIKLGRLVKAGKIKSMEEIYL
HSLPIKEYQIVDFFLPKLKDEVMKIKPVQKQTRAGQRTRFKAIVIIGDSEGHVGLGIKTSKEVATAIRAA
IIIAKLSVIPVRRGYWGTNLGTPHSLPVKESGKCGSVTVRLIPAPRGTALVASPAVKRLLQLAGIEDAYT
SSSGSTKTLENTLKATFSAVSNTYGFLTPNLWKETKLIRSPLEEFADTLRDGKRY

SEQ ID NO 461 <MG00961.4;PROTEIN;Magnaporthe grisea>

FIG. 3KK

MPREIITIQAGQCGNSIGSQFWQQLCQEHGINQDGNLEDFATEGGDRKDVFYYQSDDTRYIPRAILIDLE
PRVINGIQTGPYKNIYNPENFYVGKNGVGAANNWGDGYQTGESVHEDIMEMIDREADGSDSLEGFMMLHS
IAGGTGSGLGSFLLERLNDRFPKKIIQTYSVFPDTQNAGDVVVHPYNSILAMRRLTQNADSVVVLDNGAL
SHIAADRLHVQEPSFQQTNQLVSTVMSASTTTLRYPGYMHNDLVSILASLIPTPKCHFLMTSYTPFTGDQ
VEQAKTVRKTTVLDVMRRLLQPKNRMVSTIPGKKSCYISILNVIQGEVDPTDVHKSLLRIRERRLATFIP
WGPASIQVALTKRSPYIPMSHRVSGLMLANHTSIATVRNTFVVFLITEFILTKCALNVLQLFKRIVRQYD
GMRKRNAFIEGYKKTQPFSENLDEFDEARQVVSDLIAEYEAAEDANYLNPDAGEPGTSAETDRRMG

SEQ ID NO 463 <MGG02952.5;PROTEIN;Magnaporthe grisea>
MVRPSYSKTAKVPRRPFEAARLDSELKLVGEFGLKNKREVWRVQLTLSKIRRAARQLLTLDEKDPKRLFE
GNALIRRLVRVGVLDESRMKLDYVLALKVEDFLERRLQTCVYKLGLAKSIHHARVLIRQRHIRVGKQIVN
VPSFVVRLDSQKHIDFALTSPFGGGRPGRVRRKKAKSAEGGEDAGDDEDEE

SEQ ID NO 465 <MGG04095.5;PROTEIN;Magnaporthe grisea>
MSGVWGWFGGNAAQRRKDTPKNAILGLRSQLDMLQKREKHLQNQISEQDAIARKNISTNKNAAKAALKRK
KTHEHSLDQTLSQIGTLEQQINAIESANINMETLEAMKKAGKAMEDIHGKLTVEKVDETMDKLREQNALS
EEIVNAITNNQLGNEAIDDADLEDELEAMEQEQLDEKILKTGTGPVSDAIQRLPAAANGELKGKATTVEE
DDEEAELRKLQAEMAM

SEQ ID NO 467 <Contig2.561.g35;PROTEIN;Magnaporthe grisea>
MATIEPRLMHLLNDSKSNHDPNELPPLQSFPIPKGSAVHVSLPSLSLEIEQRDEQFAVKLPAGPPLHHIP
PFSTLNSLDDNASAQHIPPLSLVESSEDTPSSQQIPPFSTFESLDDAPHRSGPPTRLPNPTYVFDGPARI
PQTANQSIRALLGDSSPVESSSHSLRKILDDLPPELGIHDDATTKKRHRALAGKEDFVQLPQPLKKQKSA
QQVMPPIINGLHEPPPNAAVFPPISSVEFRNGDHSLSLRPLKDLGHIPEDRHAPVTPTEDKTAQPAVKTR
RRTKPRRKWTEEETNHLLIGVSRHGVGKWTSILEDPDFQFNDRTAGDLKDRFRTCCPDELRGQINPGAGA
GKGRASQAATTSPTYLTDTQARTKRTLMLENILIGNDSQPEHDALNMSPANATAASTSTSPVSSSSQPQP
KASGDASQKPRKSRAHRKKLEDLAELGISGPFKKSHRRERRPFTEQDDKEILEGIHRYGPAWTKIQRDEA
FNLSSRQPTDLRDRVRNKYPDIYAKIEKGAFQIIKEPNNSHRNNLMEPTVNTTIENSLTSVNKSGGSSLE
AQLNRTGSKENLPKWSLQHYAHDTSETSTTGHHDQPGSSLPGNSGEMDISRLKLLFQATANAFRSTVSGM
FPVTQHGCYHPQYCSYDADLQADSKKHQKRLAAPSHWLLDKLSGTYAPKPSPGPHKQRECLPLIVFIRNR
LKYALNGRETKAILMQRLVKVDGKVRTDSTYPAGFMDVVSIEKTGENFRLVYDTKGRFTVHRIQAEEAEY
KLGKVKRVQLGRGGIPFLVTHDARTIRYPDPLIKVNDTVKINLDTGKITDFIKFDTGALAMVTAGNNMGR
VGVITHRERHDGGFNIVHLKDAIDNTFTTRESNVFVIGTEKPWISLPKGKGVKLTIAEERDRRRAQTIAG
H

SEQ ID NO 469 <Contig2.887.g4;PROTEIN;Magnaporthe grisea>
MAEYGEMDEYADYEAGDYDAENDDEITAEDCWNVISSYFDEKGLVSQQIDSYNEFTTSTIQGIVDEYSVL
TLDNPNPPDTFEGKPIRLRRYEIMLGNILVTQPTVKETDGKVSTLVPYECRDRNLTYSCPLYVKLTKKVN
VAVEEDIPLHELNDEQREEMQRTNEHPTTIRWELDRDKSHNPDEKISGEKMADMIYIGKIPVMVKSRICY
LRSQPESELFLLNECPYDQGGYFIINGSEKVLIAQERSAANIVQVFKKAQPNKYLYQAEIRSALEKGSRL
VSTLTMKLTSKGDSTRGSFGQTIHLNLPYTSGDLPIAIVFRALGVVSDEDILNHIVLDKNDTQMLEMLRP
SIEEAFCIQDREVALDFIAKRVGKDGGHSNSRHLRLKVARDILQKDTLPHISQAEGCETRKAFFLGYMVH
KILQCALGRRDVDDRDHFGKKRLDLAGPLLAKLFRGIIRKLTNDMMGGLRRCIDAGRDFDLTASLKPNTL
TNGLKYSLATGNWGDQKKAASSTAGVSQVLNRYTFASTLSHLRRTNTPIGRDGKLAKPRQLHNTHWGLVC
PAETPEGQACGLVKNLSLMCMVSVGTPAEPIYDFLVARGMDVLEEYEPSNSSSTSKIFINGTWVGVANKI
EELVDLVYDLRRKSRVDPEVSLIHDVREGEFRIFSDAGRVMRPLFVVNQKDDPRTGAQAGSLVLTKEHVA
KLHADKDNNLSPGDEGHYGWQGLKSDGVLDLMDAEQEETAMICMSPSDLDKFRALKFGGATLDELEAFDK
NDINRRLNTKINPTTHMYTHCEIHPSMLLGICASIIPFPDHNQSPRNCYQSAMGKQAMGFFLTNYNRRMD
TMANILYYPQKPLGTTRSMEYLKFRELPAGQNAIVAIACYSGYNQEDSVIMNQSTIDRGLFRSLFFRSYT
DSEKRVGINMVEKFEKPFRADTLRLKQGTYDKLEDDGIVAPGTRVSGEDIIIGKTAPIPADNQELGQRTV
QHTKRDASTPLRSTESGIVDQVIVTTNQDGLKYVKVRVRTTKIPQIGDKFASRHGQKGTIGVTYRHEDMP
FTREGITPDIIINPHAIPSRMTIAHLIECLLSKVATLKGMEGDATPFTEVTVDSVSNLLREHGYQSRGFE
VLYHGHTGRKLRAQVFFGPTYYQRLRHMVDDKIHARARGPVNIMTRQPVEGRARDGGLRFGEMERDCMIA
HGAASFLKERLFEVSDAFRAHICGICGLMTPIADLTRKTFECRPCRNKTKIAQVHIPYAAKLLFQELASM

FIG. 3LL

NIATRMFTERDKKETYSFFGFLLKVHKYHRRGGKERGAQQVAWLPAPVHSQPRDEIASRVNASGKEWNDV
IFCRPRPHATRPAFLSSLQRRRLGLGACFGGQLQDQTTSTCHPNTSISRQPPTVTTPGQVNPSIRSLQPA
TSLPRPFATNRIHNGSSDAIAHRSVHGSEGDTKANHSIPNSLLKVQRAEREASKIVQKVRTKRVKEARDE
AKKEIEAYKAEKEGEYKAFESKHTQGNKQAEEEANKEAETEIKEIKEAGKKHQDKVIKDLLKAVFEPHPV
PPTAA

SEQ ID NO 471 <MGG05193.5;PROTEIN;Magnaporthe grisea>
MSADPSQDPPKKKVNLADVSGADVKEESDVATAILKKKKKPNQLMVADATNDDNSIIALSNSTMEALQLF
RGDTVLVRGKKRKDTVLIVLADDELDDGSARLNRVVRHNLRVKHGDVVTIHPCPDIKYAKRIAVLPIADT
VEGLTGSLFDVFLAPYFREAYRPVRQGDIFLVRGGMRQVEFKVVEVDPPEYGIVAQDTVIHCEGEPIQRD
EEENNLNEVGYDDIGGCRKQMAQIREMVELPLRHPQLFKSIGIKPPRGVLLYGPPGTGKTLMARAVANET
GAFFFLINGPEIMSKMAGESESNLRKAFEEAEKNSPAIIFIDEIDSIAPKREKTNGEVERRVVSQLLTLM
DGMKARSNVVVMAATNRPNSIDPALRRFGRFDREVDIGIPDPTGRLEILQIHTKNMKLGDDVDLEQIAAE
THGYVGSDVAALCSEAAMQQIREKMDLIDLDEDTIDAEVLDSLGVTMENFRFALGVSNPSALREVAVVEV
PNVRWEDIGGLDEVKQDLREQVQYPVDHPEKFLKFGLSPSRGVLFYGPPGTGKTMLAKAVANECAANFIS
VKGPELLSMWFGESESNIRDIFDKARAAAPCIVFLDELDSIAKARGGSVGDAGGASDRVVNQLLTEMDGM
TSKKNVFVIGATNRPEQLDPALCRPGRLDSLIYVPLPDELGRLSILKAQLRKTPVSDDVDLQYIANKTHG
FSGADLGFITQRAVKIAIKESITADINRTKALEAAGEDVPMDEDAEDPVPELTKRHFEEAMQQARKSVSD
VEIRRYEAFAQQMKNAGPGAFFKFPEGEGAPAASGGETFNDGGNDDGLYD

SEQ ID NO 473 <MGG09952.5;PROTEIN;Magnaporthe grisea>
MAEAQQVPTFKLVLVGDGGTGKTTFVKRHLTGEFEKKYMATLGVEVHPLGFETNFGKIQFDVWDTAGQEK
FGGLRDGYYINGQCGIIMFDVTSRITYKNVPNWHRDLVRVCENIPIVLCGNKVDVKERKVKAKTITFHRK
KNLQYYDISAKSNYNFEKPFLWLGRKLVGNPGLEFVAAPALAPPTAEVTAEQAAAYEKDLADATRAPLPD
DDDEDF

SEQ ID NO 475 <MGG06910.5;PROTEIN;Magnaporthe grisea>
MDYENLKEQWSEVEDRDGVRLSWNVFPSTRMEASRLVVPIGALYTPLKEKPDTPLLQFEPVTCKQPCRSV
LNPFCQVDVRARLWICPFCLSRNPLPPHYKDITANAIPPELHPSNTTIEYRLSRPAPSPPIFLYVVDTCQ
EDDSLNALKESLVMSLSLLPENALVGLITYGTMTQVHEIGYTECAKSYVFRGSKDYAPKQVQEMLGLGQM
PVRPGMQPQPGRPMPMGPASRFLMPVSQCEFQLTKALEQLQKDPWPVANDRRPLRCTGVALSVAVGLLES
SFQNSGGRIMLFAAGPATEGPGMVVSSELREPMRSHHDIDRDNIKYYKKALKFYDTLAKRTAHNGHIIDI
FAGCLDQVGLLEMKGLSNSTGGHMILVDSFTSSMFKQSFVRVFEKDGDDNLLMGFNGILEVLTTKELKVT
GLIGHAVSMNKKSTSVGETECGIGNTCSWKMCGIDPTSSYGIYFEVAQGGPSHAQPAQKGMMQFLTYYQH
SSGQFHLRVTTIARNIGGPAGDPAIAQSFDQEAAAVLMSRIAVFKAEVDDGPDVLRWVDRMLISLCSRFA
DYRKDDPSSFRLEKNFTLYPQFMFHLRRSQFLQVFNNSPDETAFYRHVLNHEDVSNSLIMIQPTLDTYTF
DQEGGQPVLLDSASIQPTHILLLDTFFHILIFHGETIAQWKKAGYQDQEGYENFAQLLQQPKEDAMELIT
DRFPLPRFIVCDAGGSQARFLLSKLNPSTTHTTGAYGGVGAQTAQTIFTDDVSLQTFMDHLMKLAVSGTN

SEQ ID NO 477 <Contig2.1499;PROTEIN;Magnaporthe grisea>
MAGERGNEMAEVLKDFPELEIEVEGRKEPIMKRTTLIANTSNMPVAAREASIYTGITVAEYFRDQGMNVA
MMADSSSRWAEALREISGRLGEMPADQGFPAYLSAKLASFYERAGKVNALGSPERGGSVSIVGAVSPPGG
DFSDPVTTSTLSIVQVFWGLDKKLAQRKHFPSINTSLSYSKYTMILEKWYEKEHPDFPRLRDQVRQLLSD
SEELDQVVQLVGKSALSDPDKITLDMATLLKEDFLQQNGYSDYDQFCPIWKTEWMMRLMMGFHDEAQKAI
AQGQSWSKVREATQDLQAKLKSLKFEVPTDGEEVICKKYEAIRNEMLEKFASVMDE

SEQ ID NO 479 <MGG04829.5;PROTEIN;Magnaporthe grisea>
MKYIHSEELLEVPEGVKISIKSRLITVEGPRGKLTKSLNHIAVTFSQPSKNVIGIEIHHGKRKDVATLRT
VRTLINNLIIGVTKGYKYKMRYVYAHFPINVNVEKNNETGNAEVEIRNFIGEKLVRRVAMQPGVEVEISK
AQKDELILSGNSVEAVSQSAADIQQICKVRNKDIRKFLDGMYVSEKGNIEEIAA

SEQ ID NO 481 <MG05858.4;PROTEIN;Magnaporthe grisea>

FIG. 3MM

MERFRSMMNGMGGQLGAAPGTLIDNAETVYISSLALLKMLRHGRAGVPMEVMGLMLGEFVDDFTVRVVDV
FAMPQSGTGVSVEAVDPVFQMKMMDMLRQTGRPESVVGWYHSHPGFGCWLSSVDINTQQSFEQLTPRAVA
VVVDPIQSVKGKVVIDAFRLINPQSLMLGQEPRQSTSNLGHLNKPSIQALIHGLNRHYYSININYRKTAL
EENMLMNLHKQVWTESLQMDDFRTQGQNNKERLDRLVSLSEGYEKRVKEETELTKDQLKTRYVGKLDPKK
HLEDVGQQLIEDNIVAVSRQMIDKEAAVLEKKASAVGASGKGRSEDDQMDVEEDL

SEQ ID NO 483 <Contig2.1053.g5;PROTEIN;Magnaporthe grisea>
MGIVGLVTADRGQMGANKSAQLNTVQELCRLGRGLAFIGRWLVGELLRGDRTAPLWYASRILNSRPLVRD
SLSISYSRAPISKTYTDNPKTTAKMVVLAASICTRGGKAVLSRQFREMPRSRIEALLASFPKLADSGTQH
TTVEQDNVRFVYQPLDELYMVLITNRQSNILQDIDSLHLFAQVVTSTCKSLDEREILKNAYELLSAFDEL
VTLGYRENLTISQIKTFLEMESHEERIQEIIARNKELEATEERKRKAKQLEMQRKESARSGRPGGAQRAP
VYPTYTPPSRPAVTDTYDTYEAEKNKSKFTAPKGKGMQLGKKSKTTDMFERVRGDMGNEIDDTPLVAPTA
SAAPLASEPPRRQSVGTDRDSIHITVSENITAKISREGTLNSLGVKGDLNLRVSDPTMTKIKLQLVANPT
HGAQFRIHPNVDRNLFNSSKVIQMSKADRGFPVNNSVGVLRWMATPKADDTSALPISFTVWVNKGSDGNC
TLTVEYELTGGDELRDVSVSIPYSSTEPTVSSFDATYEVSGDNLEWAIGTVNEENANGSFEFEAMADDEN
EFFPMQVRFSKTTPFVDVDISSVTLLEMNEEVTFSKDVRCTADTYLIE

SEQ ID NO 485 <Contig2.875.g14;PROTEIN;Magnaporthe grisea>
MPGYDSRCLHVDMRIQEFPEIGHSSLKRSPAGTCRQAPSAFLQGGRAVAKTTGSEGQFTEIARVVIAIMS
LPAMRQAASRALRMRGPVGRHVRMVSTASHESQQRLLSSHLQTADPAMYDIVEKEKQRQKHYINLIPSEN
FTSQAVLDALGSPMQNKYSEGYPGARYYGGNEFIDQSERLCQQRALETFGLDDKQWGVNVQALSGAPANL
YVYSALMGVHDRMMGLDLPHGGHLSHGYQTPTKKISFISKYFETVPYRLDESTGYIDYDKLEELAHIYRP
KIIVAGTSAYSRFIDYKRMREICDKVNAYMLADMAHISGMVAAKVIPGPFGYADIVTTTTHKSLRGPRGA
MIFFRKGVRSTNPKTKAEVMYDLENPINQSVFPGHQGGPHNHTIAALAVALKQAQMPEFRAYQEQVLVNA
KAFARRLGEAKGNGGGLGYKIVSGGTE Figures 4A – 4D: Hairpin sequences of *Magnaporthe grisea* target genes

FIG. 4A

SEQ ID NO 190 <MG00170.4 hairpin;DNA;Magnaporthe grisea>
cttcttgaccgtctgcgaagcaatccagttgccggcggtggcacgagagtcggtcgcaacgatgatgcct
ccctgaaacctgaaagcgagcgtcgtcgttccgtgtgcgatcttgatggggcagtttgggtttgcgtggt
cgtccgttgctgtgcggagcggaaccgcaaacttgagtgaaagacttgggacggaatcgcaaaggtcttg
ctgatcatcttctgtgaatgtctcgttctgctggtaagccgggcggctgtagcggctaccagcccgggga
gctcaggtaagtgtacacactacattttcatgaacattattgcgaccgttgagattctcattgtttggtg
attgattatctaaagtagaagcatgaatagatataacataattcgaaaactaatgggttagttatggggt
accttcatgcttttctctcagggaattcctggtagccgctacagccgcccggcttaccagcagaacgaga
cattcacagaagatgatcagcaagacctttgcgattccgtcccaagtctttcactcaagtttgcggttcc
gctccgcacagcaacggacgaccacgcaaacccaaactgccccatcaagatcgcacacggaacgacgacg
ctcgctttcaggtttcagggaggcatcatcgttgcgaccgactctcgtgccaccgccggcaactggattg
cttcgcagacggtcaagaag SEQ ID NO 191 <MG00170.4 hairpin;DNA;Magnaporthe grisea>
cgttggtaaactcgcccttctccagcttagtcttccagaagatagggttcgtgtcgttgaatccgtgctt
gacccaaccgtcctccttgacgtggtacaagttgataaaccaccggagtaggcatccctgtgggtggcg
gcgagaatgctcctgcggccgagctcgagcgcatcctcatccgacaggtcgtacttgtactcggcatcca
gcacaccataggcaaaggtctgaccggatcccacacagaacagattgccggcaagcctggtgccgtcgct
gtcgatgtagtacagggcgggaccctcctccttggtgacgccggcgcacatggtacccatgctgaggccc
atgcccttgtactggtagacgaggttggcgagaatcttggaggcggcggcgaccgagatgcggcgcttgt
ggcggagctcgtgcagacggcactgcatgcccagccaggcgagccagtactggcagtctgcggcaccgcc
ggccatggtgccgagcaggcaagagttgatctcgatgaccttcttgaccgtctgcgaagcaatccagttg
ccggcggtggcacgagagtcggtcgcaacgatgatgcctccctgaaacctgaaagcgagcgtcgtcgttc
cgtgtgcgatcttgatggggcagtttgggtttgcgtggtcgtccgttgctgtgcggagcggaaccgcaaa
cttgagtgaaagacttgggacggaatcgcaaaggtcttgctgatcatcttctgtgaatgtctcgttctgc
tggtaagccgggcggctgtagcgggctaccagggtgtccatcccggggagctcaggtaagtgtacacact
acattttcatgaacattattgcgaccgttgagattctcattgtttggtgattgattatctaaagtagaag
catgaatagatataacataattcgaaaactaatgggttagttatggggtaccttcatgcttttctctcag
ggaattcatggacaccctggtagcccgctacagccgcccggcttaccagcagaacgagacattcacagaa
gatgatcagcaagacctttgcgattccgtcccaagtctttcactcaagtttgcggttccgctccgcacag
caacggacgaccacgcaaacccaaactgccccatcaagatcgcacacggaacgacgacgctcgctttcag
gtttcagggaggcatcatcgttgcgaccgactctcgtgccaccgccggcaactggattgcttcgcagacg
gtcaagaaggtcatcgagatcaactcttgcctgctcggcaccatggccggcggtgccgcagactgccagt
actggctcgcctggctgggcatgcagtgccgtctgcacgagctccgccacaagcgccgcatctcggtcgc
cgccgcctccaagattctcgccaacctcgtctaccagtacaagggcatgggcctcagcatgggtaccatg
tgcgccggcgtcaccaaggaggagggtcccgccctgtactacatcgacagcgacggcaccaggcttgccg
gcaatctgttctgtgtgggatccggtcagacctttgcctatggtgtgctggatgccgagtacaagtacga
cctgtcggatgaggatgcgctcgagctcggccgcaggagcattctcgccgccacccacagggatgcctac
tccggtggttttatcaacttgtaccacgtcaaggaggacggttgggtcaagcacggattcaacgacacga
accctatcttctggaagactaagctggagaagggcgagtttaccaacg SEQ ID NO 192 <MG00884.4 hairpin;DNA;Magnaporthe grisea>
aggaagtaagggtgcagtgcctcctcgagggtcggttggcggaaggtcgcgcgatcaggaatatcgccca
taagaagctcaaccaccagcaaaagcttggtggccgtctgcgagaaaccaaccgcgcagttagagctcgg
tgccttccgcgtcgcagccgtcaggtgctcgtgtgcctccgtgtagcgcagctgtatggcgcgaatccga
ccaaggtagtagagataccgcgcaacttggttgtttgcagcattctcggggaactgtgtatgtgagacga
gcaggtcgcccggggagctcaggtaagtgtacacactacattttcatgaacattattgcgaccgttgaga
ttctcattgtttggtgattgattatctaaagtagaagcatgaatagatataacataattcgaaaactaat
gggttagttatggggtaccttcatgcttttctctcagggaattccgacctgctcgtctcacatacacagt
tccccgagaatgctgcaaacaaccaagttgcgcggtatctctactaccttggtcggattcgcgccataca
gctgcgctacacggaggcacacgagcacctgacggctgcgacgcggaaggcaccgagctctaactgcgcg
gttggtttctcgcagacggccaccaagcttttgctggtggttgagcttcttatgggcgatattcctgatc
gcgcgaccttccgccaaccgaccctcgaggaggcactgcacccttacttcct

FIG. 4B

SEQ ID NO 193 <MG07031.4 hairpin;DNA;Magnaporthe grisea>
atcgggatggtgatgtttgtcgaggatggagaggcagtagtactgagcatatccatgcgcagcatatggg
accggcgccagagccgcaaggtagtccagccagtagaggctcggcttgtgtgtgatggggtcgacaccgc
ccaagaggaggttgactgtgtatggcttccgcgacctcaagctcgaggcaagctcgccacggacgtaatg
cgccaatgcggacggtgaaagatcggtctcgttacgcatcgaatagagcttcgcgtttgccatgatgtac
tccccggggagctcaggtaagtgtacacactacattttcatgaacattattgcgaccgttgagattctca
ttgtttggtgattgattatctaaagtagaagcatgaatagatataacataattcgaaaactaatgggtta
gttatggggtaccttcatgcttttctctcagggaattcgggagtacatcatggcaaacgcgaagctctat
tcgatgcgtaacgagaccgatctttcaccgtccgcattggcgcattacgtccgtggcgagcttgcctcga
gcttgaggtcgcggaagccatacacagtcaacctcctcttgggcggtgtcgaccccatcacacacaagcc
gagcctctactggctggactaccttgcggctctggcgccggtcccatatgctgcgcatggatatgctcag
tactactgcctctccatcctcgacaaacatcaccatcccgat

SEQ ID NO 194 <MG04484.4 hairpin;DNA;Magnaporthe grisea>
aaccaggcggttgtcgtcggtgacggtgccgacaacgacaacggtcttcttctcgttgccgttcttcagg
ttgcctgcgatgcgcgacagggagacgggagggcggttggtgcgcgacataaagaggcggcgaaggacaa
ccttgttgaagctggagtcggtcctgcgggccaggaagcggtagagcttcaccaagagcttgaggtagac
attgtcgctcttggggggccttgcggtgcgtgctgcgcacgtggtgcttcttaagatcgatcccggggagc
tcaggtaagtgtacacactacattttcatgaacattattgcgaccgttgagattctcattgtttggtgat
tgattatctaaagtagaagcatgaatagatataacataattcgaaaactaatgggttagttatggggtac
cttcatgcttttctctcagggaattcatcgatcttaagaagcaccacgtgcgcagcacgcaccgcaaggc
cccaagagcgacaatgtctacctcaagctcttggtgaagctctaccgcttcctggcccgcaggaccgac
tccagcttcaacaaggttgtccttcgccgcctctttatgtcgcgcaccaaccgccctcccgtctccctgt
cgcgcatcgcaggcaacctgaagaacggcaacgagaagaagaccgttgtcgttgtcggcaccgtcaccga
cgacaaccgcctggtt

SEQ ID NO 195 <MG04484.4 hairpin;DNA;Magnaporthe grisea>
ttagaccttgaaaccacgcgatcgtctgcgaccacgggccttctcgaacttgcggcccttggactggacg
taaggcttcttgtgcttgtggggaccgaagccgaagtgcttgacagcctcacgggcgttcttggggccgc
ggaggaggagggtgttggcaccagtgggcttctcaagagccagctggtcaagggtgatggcctggccgcc
ggcggcaacgatgcgggcacgggcggtggcggtgaagcgaagggcagcgacctgggccttggggcactca
accaggcggttgtcgtcggtgacggtgccgacaacgacaacggtcttcttctcgttgccgttcttcaggt
tgcctgcgatgcgcgacagggagacgggagggcggttggtgcgcgacataaagaggcggcgaaggacaac
cttgttgaagctggagtcggtcctgcgggccaggaagcggtagagcttcaccaagagcttgaggtagaca
ttgtcgctcttggggggccttgcggtgcgtgctgcgcacgtggtgcttcttaagatcgatacccatcccgg
ggagctcaggtaagtgtacacactacattttcatgaacattattgcgaccgttgagattctcattgtttg
gtgattgattatctaaagtagaagcatgaatagatataacataattcgaaaactaatgggttagttatgg
ggtaccttcatgcttttctctcagggaattcatgggtatcgatcttaagaagcaccacgtgcgcagcacg
caccgcaaggcccccaagagcgacaatgtctacctcaagctcttggtgaagctctaccgcttcctggccc
gcaggaccgactccagcttcaacaaggttgtccttcgccgcctctttatgtcgcgcaccaaccgccctcc
cgtctccctgtcgcgcatcgcaggcaacctgaagaacggcaacgagaagaagaccgttgtcgttgtcggc
accgtcaccgacgacaaccgcctggttgagtgccccaaggcccaggtcgctgcccttcgcttcaccgcca
ccgcccgtgcccgcatcgttgccgccggcggccaggccatcacccttgaccagctggctcttgagaagcc
cactggtgccaacaccctcctcctccgcggccccaagaacgcccgtgaggctgtcaagcacttcggcttc
ggtccccacaagcacaagaagccttacgtccagtccaagggccgcaagttcgagaaggcccgtggtcgca
gacgatcgcgtggtttcaaggtctaa

SEQ ID NO 196 <MG02946.4 hairpin;DNA;Magnaporthe grisea>
Cgcatccgcccgaccagccgccagcgccgtgccacgcccggccttgtactcggccttgcgccactcgtag
tacggattgtacgcgtcgctctggctcgtgacgaagctgaactttgggttcccgctgtggttctcgcgta
ggcgctgctcgatgcccagtccaccacgcgccacgtacccggccgtcttttcaatcacctcgcggatctc
accgggtggcggaatgatgacgccctcgggaggcctgaggccgtcgagctgtgccgcggccgcagtcccg
gggagctcaggtaagtgtacacactacattttcatgaacattattgcgaccgttgagattctcattgttt
ggtgattgattatctaaagtagaagcatgaatagatataacataattcgaaaactaatgggttagttatg

FIG. 4C gggtaccttcatgcttttctctcagggaattcactgcggccgcggcacagctcgacggcctcaggcctcc
cgagggcgtcatcattccgccacccggtgagatccgcgaggtgattgaaaagacggccgggtacgtggcg
cgtggtggactgggcatcgagcagcgcctacgcgagaaccacagcgggaacccaaagttcagcttcgtca
cgagccagagcgacgcgtacaatccgtactacgagtggcgcaaggccgagtacaaggccgggcgtggcac
ggcgctggcggctggtcgggcggatgcg

SEQ ID NO 197 <MG07472.4 hairpin;DNA;Magnaporthe grisea>
tgtccacattgaaagggtccgcgcctgcagcatccttttcgaactgcactggaccttctcgggcttccac
atccccggcaccggagaatgtacctcggcctagcacctcaccatatctgctcgccttttgtatcttggcc
atctccgcatcgccagccgcctcgtcctcatcatcgttgttcgcacgggccggtagatactactgatgg
cgtcctgaacagcaaaaagcggcttgtcataagggttgtcctcgttgatgccgccctcgaaaccagatga
ttggcccggggagctcaggtaagtgtacacactacattttcatgaacattattgcgaccgttgagattct
cattgtttggtgattgattatctaaagtagaagcatgaatagatataacataattcgaaaactaatgggt
tagttatggggtaccttcatgcttttctctcagggaattcccaatcatctggtttcgagggcggcatcaa
cgaggacaacccttatgacaagccgctttttgctgttcaggacgccatcagtagtatctaccggccccgt
gcgaacaacgatgatgaggacgaggcggctggcgatgcggagatggccaagatacaaaggcgagcagat
atggtgaggtgctaggccgaggtacattctccggtgccggggatgtggaagcccgagaaggtccagtgca
gttcgaaaaggatgctgcaggcgcggaccctttcaatgtggaca

SEQ ID NO 198 <MG06292.4 hairpin;DNA;Magnaporthe grisea>
caaagtgctcatgcccttgaagtgtgtaggcatatgcaaattttgcgtcgagctgcgtagcacgcttgaa
gcaccgcagcgcttgttcgcgatctgatgccagcgaccatgcattgcccaaggcgcaccaggcgtgcggt
gaatgccacgctatgtcaacaagctcgtgtgccagaaacgatgcctctgtttccttcttcaggtgccaaa
gtactgtggaatagacctccatgtcctccagccgattcggtgccaatgttcttaagcgcttgaaggaggc
ctctgcttcagcatacccggggagctcaggtaagtgtacacactacattttcatgaacattattgcgacc
gttgagattctcattgtttggtgattgattatctaaagtagaagcatgaatagatataacataattcgaa
aactaatgggttagttatggggtaccttcatgcttttctctcagggaattctatgctgaagcagaggcct
ccttcaagcgcttaagaacattggcaccgaatcggctggaggacatggaggtctattccacagtactttg
gcacctgaagaaggaaacagaggcatcgtttctggcacacgagcttgttgacatagcgtggcattcaccg
cacgcctggtgcgccttgggcaatgcatggtcgctggcatcagatcgcgaacaagcgctgcggtgcttca
agcgtgctacgcagctcgacgcaaaatttgcatatgcctacacacttcaagggcatgagcactttg

SEQ ID NO 199 <MG03668.4 hairpin;DNA;Magnaporthe grisea>
aatcggtcctgtgcatcggtgggccccttccagaagccgccctgctgggaggaagatcccgctcagggcc
accgctagccttggcctgctcacgttcacgccagctgggcttggcaccgtcagcacgagcaaggttaagc
cggggcggaccaccagcacgatcgtttgaatcagtgcgctccatggggtaccagttcgggcaggagcag
ggcgctccgagggacgctcagaacgctccgagggagcggctccgacgtttgaagatgggaccctgtcacc
ccggggagctcaggtaagtgtacacactacattttcatgaacattattgcgaccgttgagattctcattg
tttggtgattgattatctaaagtagaagcatgaatagatataacataattcgaaaactaatgggttagtt
atggggtaccttcatgcttttctctcagggaattcgtgacagggtcccatcttcaaacgtcggagccgct
ccctcggagcgttctgagcgtccctcggagcgccctgctcctgcccgaactggtaccccatggagcgca
ctgattcaaacgatcgtgctggtggtccgccccggcttaaccttgctcgtgctgacggtgccaagcccag
ctggcgtgaacgtgagcaggccaaggctagcggtggccctgagcgggatcttcctcccagcagggcggct
tctggaaggggcccaccgatgcacaggaccgatt

SEQ ID NO 200 <MG03668.4 hairpin;DNA;Magnaporthe grisea>
Atcgtttgccgcattgacgatgaaagcgttgagaacctcatacgcggccgtcctgacagccgagtcgcaa
tcgttcttggcggtgacgtccaggaggctgcgcacactgtcgttgaagtaggcagtgatggcattctggg
gcgctccgggctcaccggcaaaacgttccgccaggttcatcagagcccaacagcacgaggcggccatctt
gggagtgtttagcaggccagcaaacaacgagcggatcagaggctcgaggtgctggctggggtcaatagcc
tcggagcaggcccggggagctcaggtaagtgtacacactacattttcatgaacattattgcgaccgttga
gattctcattgtttggtgattgattatctaaagtagaagcatgaatagatataacataattcgaaaacta
atgggttagttatggggtaccttcatgcttttctctcagggaattccctgctccgaggctattgacccca
gccagcacctcgagcctctgatccgctcgttgtttgctggcctgctaaacactcccaagatggccgcctc
gtgctgttgggctctgatgaacctggcggaacgttttgccggtgagcccggagcgccccagaatgccatc FIG. 4D actgcctacttcaacgacagtgtgcgcagcctcctggacgtcaccgccaagaacgattgcgactcggctg
tcaggacggccgcgtatgaggttctcaacgctttcatcgtcaatgcggcaaacgat SEQ ID NO 201 <MG00604.4 hairpin;DNA;Magnaporthe grisea>
ctactcctcgccctcaagaggggcctcctcctcgtactcctcttcctcctcgtcaacaccagcatcctgg
tactgctggtactcggaaacaagatcgttcatgttggactcggcctcagtgaactccatctcgtccatac
cctcaccagtgtaccaatgcaagaaagccttgcgcctgaacatggcagtgaactcccggg**gagctcaggt
aagtgtacacactacattttcatgaacattattgcgaccgttgagattctcattgtttggtgattgatta
tctaaagtagaagcatgaatagatataacataattcgaaaactaatgggttagttatggggtaccttcat
gcttttctctcagg**gaattcagttcactgccatgttcaggcgcaaggctttcttgcattggtacactggt
gagggtatggacgagatggagttcactgaggccgagtccaacatgaacgatcttgtttccgagtaccagc
agtaccaggatgctggtgttgacgaggaggaagaggagtacgaggaggaggcccctcttgagggcgagga
gtag SEQ ID NO 202 <MG00604.4 hairpin (3x194);DNA;Magnaporthe grisea>
ctactcctcgccctcaagaggggcctcctcctcgtactcctcttcctcctcgtcaacaccagcatcctgg
tactgctggtactcggaaacaagatcgttcatgttggactcggcctcagtgaactccatctcgtccatac
cctcaccagtgtaccaatgcaagaaagccttgcgcctgaacatggcagtgaactctactcctcgccctca
agaggggcctcctcctcgtactcctcttcctcctcgtcaacaccagcatcctggtactgctggtactcgg
aaacaagatcgttcatgttggactcggcctcagtgaactccatctcgtccataccctcaccagtgtacca
atgcaagaaagccttgcgcctgaacatggcagtgaactctactcctcgccctcaagaggggcctcctcct
cgtactcctcttcctcctcgtcaacaccagcatcctggtactgctggtactcggaaacaagatcgttcat
gttggactcggcctcagtgaactccatctcgtccataccctcaccagtgtaccaatgcaagaaagccttg
cgcctgaacatggcagtgaactcccggg**gagctcaggtaagtgtacacactacattttcatgaacattat
tgcgaccgttgagattctcattgtttggtgattgattatctaaagtagaagcatgaatagatataacata
attcgaaaactaatgggttagttatggggtaccttcatgcttttctctcagg**aattcagttcactgccat
gttcaggcgcaaggctttcttgcattggtacactggtgagggtatggacgagatggagttcactgaggcc
gagtccaacatgaacgatcttgtttccgagtaccagcagtaccaggatgctggtgttgacgaggaggaag
aggagtacgaggaggaggcccctcttgagggcgaggagtagagttcactgccatgttcaggcgcaaggct
ttcttgcattggtacactggtgagggtatggacgagatggagttcactgaggccgagtccaacatgaacg
atcttgtttccgagtaccagcagtaccaggatgctggtgttgacgaggaggaagaggagtacgaggagga
ggcccctcttgagggcgaggagtagagttcactgccatgttcaggcgcaaggctttcttgcattggtaca
ctggtgagggtatggacgagatggagttcactgaggccgagtccaacatgaacgatcttgtttccgagta
ccagcagtaccaggatgctggtgttgacgaggaggaagaggagtacgaggaggaggcccctcttgagggc
gaggagtag SEQ ID NO 203 <Seastar#2 AFP hairpin;DNA;Magnaporthe grisea>
gccatcacgaacgtacataatctcagtggatggttcccacctcaaagttttcttctgcattactggacca
ttgggaggaaagttcaccccatcaaaacgaattttatagataaagcagtcgtcttccatgctgacgtcag
tttccacggtgacaatgcctttgtcttcaaaagtcatgcttctttcccaggaatatccctcgggaaacga
ctgcttgaaatagtctgctatatcgtctgggtatttggtcaatgctctgtttccgtacgcgaacgcgttt
gacaagatatcgcccggg**gagctcaggtaagtgtacacactacattttcatgaacattattgcgaccgtt
gagattctcattgtttggtgattgattatctaaagtagaagcatgaatagatataacataattcgaaaac
taatgggttagttatggggtaccttcatgcttttctctcagg**gaattccgatatcttgtcaaacgcgttc
gcgtacggaaacagagcattgaccaaatacccagacgatatagcagactatttcaagcagtcgtttcccg
agggatattcctgggaaagaagcatgacttttgaagacaaaggcattgtcaccgtggaaactgacgtcag
catggaagacgactgctttatctataaaattcgttttgatggggtgaactttcctcccaatggtccagta
atgcagaagaaaactttgaggtgggaaccatccactgagattatgtacgttcgtgatggc (A)

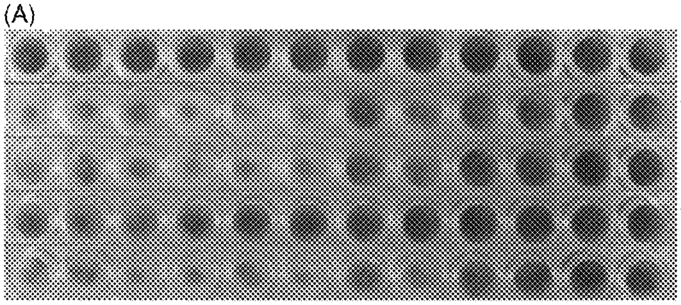

(B)

| dsRNA concentration | 4 μM | 2 μM | 1 μM | 0.5 μM |
|---|---|---|---|---|
| MG00170.4 (target 1) | ++++ | ++-x | ---- | No data |
| MG09222.5 (target 5) | +x++ | ++-x | ---- | No data |
| MG02952.5 (target 14) | xxx- | ---- | ---- | No data |
| MG05193.5 (target 19) | +x++ | ++-+ | ---- | No data |
| MG00884.4 (target 2) | ++++ | +++x | ---- | No data |
| MG07031.4 (target 3) | x+++ | -x-x | ---- | No data |
| MG04484.4 (target 4) | xx+- | -x+- | ---- | No data |
| MG02946.4 (target 6) | No data | ++++ | ++x+ | ---- |
| MG07472.4 (target 7) | No data | ++++ | ++xx | ---- |
| MG06292.4 (target 8) | No data | +x++ | --xx | ---- |
| MG03668.4 (target 9) | No data | ++++ | ++++ | -x-- |
| MG10192.4 (target 10) | No data | ++-+ | x--x | ---- |
| MG00604.4 (target 11) | ++++ | ++++ | ++++ | xxxx |
| MG04095.5 (target 15) | --xx | ---- | ---- | No data |
| contig2.561.g35 (target 17) | -x-x | ---- | ---- | No data |
| contig2.887.g4 (target 18) | ---x | ---- | ---- | No data |
| MG09952.5 (target 20) | ++++ | ---- | ---- | No data |
| contig2.1499.g3 (target 22) | xx+x | -x-- | ---- | No data |
| MG04829.5 (target 23) | ++++ | +x+- | ---- | No data |
| MG5858.4 (target 25) | ---x | +--- | ---- | No data |
| contig2.1053.g5 (target 27) | ++++ | ++-x | ---- | No data |
| contig2.875.g14 (target 28) | ---x | ---- | ---- | No data |
| Seastar (neg control) | ---- | ---- | ---- | No data |
| GFP (neg control) | No data | ---- | ---- | No data |
| GST (neg control) | No data | ---- | ---- | No data |

Figure 8

METHOD FOR DOWN-REGULATING GENE EXPRESSION IN FUNGI

RELATED APPLICATIONS

This application is divisional of U.S. application Ser. No. 11/396,926, filed Apr. 3, 2006, which is a continuation-in-part of PCT/IB2005/003495, filed Oct. 4, 2005, which claims the benefit under 35 U.S.C. §119(e) of U.S. provisional application 60/615,695, filed Oct. 4, 2004, the entire disclosures of which are incorporated herein by reference.

FIELD OF THE INVENTION

The invention relates to methods for controlling fungal growth on cells or organisms, methods for preventing fungal infestation of cells or organism and methods for down-regulating gene expression in fungi using double-stranded RNA. The invention also relates to transgenic plants resistant to fungal infestation.

BACKGROUND TO THE INVENTION

RNA interference or "RNAi" is a process of sequence-specific down-regulation of gene expression (also referred to as "gene silencing" or "RNA-mediated gene silencing") initiated by double-stranded RNA (dsRNA) that is complementary in sequence to a region of the target gene to be down-regulated (Fire, A. Trends Genet. Vol. 15, 358-363, 1999; Sharp, P. A. Genes Dev. Vol. 15, 485-490, 2001).

Over the last few years, down-regulation of target genes in multicellular organisms by means of RNA interference (RNAi) has become a well established technique. In general, RNAi comprises contacting the organism with a double-stranded RNA fragment (generally either as two annealed complementary single-strands of RNA or as a hairpin construct) having a sequence that corresponds to at least part of a gene to be down-regulated (the "target gene"). Reference may be made to International application WO 99/32619 (Carnegie Institute of Washington), International application WO 99/53050 (Benitec), and to Fire et al., Nature, Vol. 391, pp. 806-811, February 1998 for general description of the RNAi technique.

In nematodes, RNAi can be performed by feeding the nematode with the RNAi fragment or with a bacterial strain that either contains the RNAi fragment or that upon ingestion by the nematode is capable of expressing the RNAi fragment. For a description of this so-called "RNAi by feeding", reference may be made to International application WO 00/01846 by the present applicant, to 1998 East Coast Worm Meeting abstract 180—Timmons and Fire "*Creation Of Hypomorphic Pseudo-Mutants Via Bacterial-Mediated RNAi.*" *East Coast Worm Meeting* (1998), and again to WO 99/32619.

RNAi has also been proposed as a means of protecting plants against plant parasitic nematodes, i.e. by expressing in the plant (e.g. in the entire plant, or in a part, tissue or cell of a plant) one or more nucleotide sequences that form a dsRNA fragment that corresponds to a target gene in the plant parasitic nematode that is essential for its growth, reproduction and/or survival. Reference may be made to U.S. Pat. No. 6,506,559 (based on WO 99/32619), column 11, line 55 to column 12, line 9 and column 13, line 61 to column 14, line 11), International application WO 00/01846 by the present applicant, page 7, lines 11-8, and International applications WO 01/96584, WO 01/37654 and WO 03/052110 for a description of such techniques.

Elbashir et al. (Nature, 411, 494-498, 2001) have demonstrated effective RNAi-mediated gene silencing in mammalian cells using dsRNA fragments of 21 nucleotides in length (also termed small interfering RNAs or siRNAs). These short siRNAs demonstrate effective and specific gene silencing, whilst avoiding the interferon-mediated non-specific reduction in gene expression which has been observed with the use of dsRNAs greater than 30 bp in length in mammalian cells (Stark G. R. et al., Ann Rev Biochem. 1998, 67: 227-264; Manche, L et al., Mol Cell Biol., 1992, 12: 5238-5248). Thus, RNAi has been proposed as an alternative to the use of antisense technology for specific down-regulation or gene silencing of target genes in mammalian cells.

Although the technique of RNAi has been generally known in the art in plants, nematodes and mammalian cells for some years, to date little is known about the use of RNAi to down-regulate gene expression in fungi.

Kadotani et al. (2003) Mol Plant Microbe Interac. 16: 769-776 describe RNA-mediated gene silencing in the ascomycete fungus *Magnaporthe oryzae* (formerly *Magnaporthe grisea*; anamorph *Pyricularia oryzae* Cav. and *Pyricularia grisae*), the causal agent of rice blast disease, by a mechanism having molecular features consistent with RNAi. Gene silencing was achieved by expression of dsRNA inside cells of the fungus: fungal protoplasts were transformed in the laboratory using DNA constructs capable of expressing the double-stranded RNA, such that the double-stranded RNA is transcribed within cells of the fungus.

Cogoni and Macino, (1999) Nature. 399: 166-169 describe gene silencing by RNAi in the filamentous fungus *Neurospora crassa*. Gene silencing was achieved by transforming fungal cells with a transgene capable of expressing the double-stranded RNA, allowing the double-stranded RNA to be transcribed within cells of the fungus.

Liu et al. (2002) Genetics. 160: 463-470 describe RNA interference in the human pathogenic fungus *Cryptococcus neoformans*. Again, RNAi was achieved by transforming fungal cells in culture with a DNA construct encoding the double-stranded RNA, such that the double-stranded RNA was transcribed in situ in the fungal cells.

These studies confirm that RNA interference pathways are active in a number of different species of fungi. However, to date RNAi has only been achieved in fungi by transcription of dsRNA within cells of the fungus, following transformation of fungal cells with a DNA construct or transgene from which the appropriate dsRNA may be transcribed.

RNAi techniques requiring transformation of fungal cells with a DNA construct that directs production of dsRNA within the fungal cells are useful for experimental studies within the laboratory but are clearly not suitable for many potential practical applications of RNAi, for example applications which require dsRNA to be introduced into many fungal cells on a large scale or in the field, for example, to protect plants against plant pathogenic fungi or large scale treatment of substrates to protect against fungal infestation, or for pharmaceutical or veterinary use in the treatment or prevention of fungal infestation in humans or animals.

DESCRIPTION OF THE INVENTION

It has now been found by the present inventors that gene expression can be specifically down-regulated in fungi by contacting intact fungal cells (i.e. with an intact cell wall) with double-stranded RNA outside the cell (i.e. external to the cell wall), wherein the double-stranded RNA comprises annealed complementary strands, one of which has a nucleotide sequence which corresponds to (i.e. is complementary to at least part of) a target nucleotide sequence of a target gene of a fungus to be down-regulated.

It has surprisingly been found that when intact fungal cells are contacted with double-stranded RNA outside the cell wall, the double-stranded RNA is taken up by the fungal cells in amounts sufficient to specifically cause inhibition of growth. This approach to RNAi in fungi avoids the need for complicated transformation procedures in order to introduce a transgene capable of directing expression of double-stranded RNA within cells of the fungus. Accordingly, there is no need for the fungus itself to be genetically manipulated and in particular no need to transform the fungal cells using non-natural procedures in order to introduce a DNA construct directing expression of dsRNA within the fungal cells. Hence, the technique is simple and of great practical utility and opens up a whole range of different applications of RNAi in fungi that simply would not be practical using the prior art techniques.

The methods of the invention can find practical application in any area of technology where it is desirable to inhibit viability, growth, development or reproduction of the fungus, or to decrease pathogenicity or infectivity of the fungus. The methods of the invention further find practical application where it is desirable to specifically down-regulate expression of one or more target genes in a fungus. Particularly useful practical applications include, but are not limited to, (1) protecting plants against plant pathogenic fungi; (2) pharmaceutical or veterinary use in humans and animals (for example to control, treat or prevent fungal infections in humans); (3) protecting materials against damage caused by fungi; (4) protecting perishable materials (such as foodstuffs, seed, etc.) against damage caused by fungi; (5) functional genomics in fungi to elucidate the gene function of fungal target genes and generally any application wherein fungi need to be controlled and/or wherein damage caused by fungi needs to be prevented.

In accordance with one embodiment the invention relates to a method for controlling fungal growth in or on a cell or an organism or for preventing fungal infestation of a cell or an organism susceptible to fungal infection, comprising contacting fungal cells with a double-stranded RNA from outside the fungal cell(s), wherein the double-stranded RNA comprises annealed complementary strands, one of which has a nucleotide sequence which is complementary to at least part of the nucleotide sequence of a fungal target gene, whereby the double-stranded RNA is taken up into the fungal cells and thereby controls growth or prevents infestation.

The expression "complementary to at least part of" as used herein means that the nucleotide sequence is fully complementary to the nucleotide sequence of the target over more than two nucleotides, for instance over at least 15, 16, 17, 18, 19, 20, 21, 22, 23 or 24 contiguous nucleotides.

According to a further embodiment, the invention relates to a method for down-regulating expression of a target gene in a fungus, comprising contacting fungal cell(s) with a double-stranded RNA from outside the fungal cell(s), wherein the double-stranded RNA comprises annealed complementary strands, one of which has a nucleotide sequence which is complementary to at least part of the nucleotide sequence of the fungal target gene to be down-regulated, whereby the double-stranded RNA is taken up into the fungal cells and thereby down-regulates expression of the fungal target gene.

According to one embodiment, the methods of the invention rely on uptake into fungal cells of double-stranded RNA present outside of the fungus (i.e. external to the cell wall) and does not require expression of double-stranded RNA within cells of the fungus. In addition, the present invention also encompasses methods as described above wherein the fungal cell(s) is contacted with a composition comprising the double-stranded RNA.

Said double-stranded RNA may be expressed by a prokaryotic (for instance but not limited to a bacterial) or eukaryotic (for instance but not limited to a yeast) host cell or host organism, or a symbiotic organism (e.g. green algae or cyanbacterium).

According to another embodiment, the methods of the invention rely on a GMO approach wherein the double-stranded RNA is expressed by a cell or an organism infested with or susceptible to infestation by fungi. Preferably, said cell is a plant cell or said organism is a plant.

Preferably, the present invention extends to methods as described herein, wherein said target gene comprises a sequence which is selected from the group comprising: (i) sequences which are at least 75%, at least 80% or 85% identical, preferably at least 90%, 95%, 96%, or more preferably at least 97%, 98% and still more preferably at least 99% identical to a sequence represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof, and (ii) sequences comprising at least 17, preferably at least 18, 19, 20 or 21, more preferably at least 22, 23 or 24 contiguous nucleotides of any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof, or wherein said target gene is an orthologue of a gene comprising at least 17 contiguous nucleotides of any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof.

The present invention thus also relates to a method for producing a plant resistant to a plant pathogenic fungus, comprising:

(a) transforming a plant cell with a recombinant construct comprising at least one regulatory sequence operably linked to a sequence complementary to at least part of a nucleotide sequence of a target fungal gene selected from the group consisting of:

(i) a nucleotide sequence of at least 17, preferably at least 18, 19, 20 or 21, more preferably at least 22, 23 or 24 nucleotides in length encoding an RNA which is complementary to a fungal target gene comprising a sequence which is at least 75%, preferably at least 80%, 85%, 90%, more preferably at least 95%, 98% or 99% identical to a sequence selected from the group of sequences represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof, or wherein said fungal target gene is a fungal orthologue of a gene comprising any of SEQ ID Nos 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, and (ii) a nucleotide sequence comprising a sense strand comprising the nucleotide sequence of (i) and an antisense strand comprising the complement of said nucleotide sequence of (i), wherein the transcript encoded by said nucleotide sequence is capable of forming a double-stranded RNA, (b) regenerating a plant from the transformed plant cell; and (c) growing the transformed plant under conditions suitable for the expression of the recombinant construct, said grown transformed plant resistant to fungi compared to an untransformed plant, hereby producing a fungus-resistant plant.

According to still other embodiments, in the methods of the invention, the double-stranded RNA is expressed from a recombinant construct, which construct comprises at least one regulatory sequence operably linked to said nucleotide sequence which is complementary to at least part of said nucleotide sequence of said fungal target gene to be down-regulated.

The fungal cell(s) can be any fungal cell, meaning any cell present within or derived from an organism belonging to the Kingdom Fungi. The methods of the invention are applicable to all fungi and fungal cells that are susceptible to gene silencing by RNA interference and that are capable of internalising double-stranded RNA from their immediate environment.

In one embodiment of the invention, the fungus may be a mould, or more particularly a filamentous fungus. In other embodiments of the invention, the fungus may be a yeast.

In one embodiment the fungus may be an ascomycetes fungus, i.e. a fungus belonging to the Phylum *Ascomycota.*

In preferred, but non-limiting, embodiments of the invention the fungal cell is chosen from the group consisting of:

(1) a fungal cell of, or a cell derived from a plant pathogenic fungus, such as but not limited to *Acremoniella* spp., *Alternaria* spp. (e.g. *Alternaria brassicola* or *Alternaria solani*), *Ascochyta* spp. (e.g. *Ascochyta pisi*), *Botrytis* spp. (e.g. *Botrytis cinerea* or *Botryotinia fuckeliana*), *Cladosporium* spp., *Cercospora* spp. (e.g. *Cercospora kikuchii* or *Cercospora zaea-maydis*), *Cladosporium* spp. (e.g. *Cladosporium fulvum*), *Colletotrichum* spp. (e.g. *Colletotrichum lindemuthianum*), *Curvularia* spp., *Diplodia* spp. (e.g. *Diplodia maydis*), *Erysiphe* spp. (e.g. *Erysiphe graminis* f.sp. *graminis, Erysiphe graminis* f.sp. *hordei* or *Erysiphe pisi*), *Erwinia armylovora, Fusarium* spp. (e.g. *Fusarium nivale, Fusarium sporotrichioides, Fusarium oxysporum, Fusarium graminearum, Fusarium germinearum, Fusarium culmorum, Fusarium solani, Fusarium moniliforme* or *Fusarium roseum*), *Gaeumanomyces* spp. (e.g. *Gaeumanomyces graminis* f.sp. *tritici*), *Gibberella* spp. (e.g. *Gibberella zeae*), *Helminthosporium* spp. (e.g. *Helminthosporium turcicum, Helminthosporium carbonum, Helminthosporium mavdis* or *Helminthosporium sigmoideum*), *Leptosphaeria salvinii, Macrophomina* spp. (e.g. *Macrophomina phaseolina*), *Magnaportha* spp. (e.g. *Magnaporthe oryzae*), *Mycosphaerella* spp., *Nectria* spp. (e.g. *Nectria heamatococca*), *Peronospora* spp. (e.g. *Peronospora manshurica* or *Peronospora tabacina*), *Phoma* spp. (e.g. *Phoma betae*), *Phakopsora* spp. (e.g. *Phakopsora pachyrhizi*), *Phymatotrichum* spp. (e.g. *Phymatotrichum omnivorum*), *Phytophthora* spp. (e.g. *Phytophthora cinnamomi, Phytophthora cactorum, Phytophthora phaseoli, Phytophthora parasitica, Phytophthora citrophthora, Phytophthora megasperma* f.sp. *soiae* or *Phytophthora infestans*), *Plasmopara* spp. (e.g. *Plasmopara viticola*), *Podosphaera* spp. (e.g. *Podosphaera leucotricha*), *Puccinia* spp. (e.g. *Puccinia sorghi, Puccinia striiformis, Puccinia graminis* f.sp. *tritici, Puccinia asparagi, Puccinia recondita* or *Puccinia arachidis*), *Pythium* spp. (e.g. *Pythium aphanidermatum*), *Pyrenophora* spp. (e.g. *Pyrenophora triticirepentens* or *Pyrenophora teres*), *Pyricularia* spp. (e.g. *Pyricularia oryzae*), *Pythium* spp. (e.g. *Pythium ultimum*), *Rhincosporium secalis, Rhizoctonia* spp. (e.g. *Rhizoctonia solani, Rhizoctonia oryzae* or *Rhizoctonia cerealis*), *Rhizopus* spp. (e.g. *Rhizopus chinensid*), *Scerotium* spp. (e.g. *Scerotium rolfsii*), *Sclerotinia* spp. (e.g. *Sclerotinia sclerotiorum*), *Septoria* spp. (e.g. *Septoria lycopersici, Septoria glycines, Septoria nodorum* or *Septoria tritici*), *Thielaviopsis* spp. (e.g. *Thielaviopsis basicola*), *Tilletia* spp., *Trichoderma* spp. (e.g. *Trichoderma virde*), *Uncinula* spp. (e.g. *Uncinula necator*), *Ustilago maydis* (e.g. corn smut), *Venturia* spp. (e.g. *Venturia inaequalis* or *Venturia pirina*) or *Verticillium* spp. (e.g. *Verticillium dahliae* or *Verticillium albo-atrum*);

(2) a fungal cell of, or a cell derived from a fungus capable of infesting humans such as, but not limited to, *Candida* spp., particularly *Candida albicans*; Dermatophytes including *Epidermophyton* spp., *Trichophyton* spp, and *Microsporum* spp.; *Aspergillus* spp. (particularly *Aspergillus flavus, Aspergillus fumigatus, Aspergillus nidulans, Aspergillus niger* or *Aspergillus terreus*); *Blastomyces dermatitidis; Paracoccidioides brasiliensis; Coccidioides immitis; Cryptococcus neoformans; Histoplasma capsulatum* Var. *capsulatum* or Var. *duboisii; Sporothrix schenckii; Fusarium* spp.; *Scopulariopsis brevicaulis; Fonsecaea* spp.; *Penicillium* spp.; or Zygomycetes group of fungi (particularly *Absidia corymbifera, Rhizomucor pusillus* or *Rhizopus arrhizus*);

(3) a fungal cell of, or a cell derived from a fungus capable of infesting animals such as, but not limited to *Candida* spp., *Microsporum* spp. (particularly *Microsporum canis* or *Microsporum gypseum*), *Trichophyton mentagrophytes, Aspergillus* spp., or *Cryptococcus neoforman;* and (4) a fungal cell of, or a cell derived from a fungus that causes unwanted damage to substrates or materials, such as fungi that attack foodstuffs, seeds, wood, paint, plastic, clothing etc. Examples of such fungi are the moulds, including but not limited to *Stachybotrys* spp., *Aspergillus* spp., *Alternaria* spp., *Cladosporium* spp., *Penicillium* spp. or *Phanerochaete chrysosporium.*

Preferred plant pathogenic fungi according to the invention are *Cercospora* spp. (e.g. *Cercospora kikuchii* or *Cercospora zaea-maydis*) causing e.g. black and yellow sigatoka in banana; *Colletotrichum* spp. (e.g. *Colletotrichum lindemuthianum*) causing e.g. anthracnose in corn; *Curvularia* spp. causing seedling blight; *Diplodia* spp. (e.g. *Diplodia maydis*) causing e.g. ear, kernel and stalk rots in corn; *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*) causing e.g. ear, kernel and stalk rots in corn, fusarium wilt in cotton and Panama disease in banana; *Gibberella* spp. causing e.g. ear, kernel and stalk rots in corn; *Magnaportha* spp. (e.g. *Magnaporthe oryzae*) causing rice blast; *Mycosphaerella* spp. causing e.g. black and yellow sigatoka in banana; *Phakopsora* spp. (e.g. *Phakopsora pachyrhizi*) causing e.g. soybean rust; *Phytophthora* spp. (e.g. *Phytophthora cinnamomi, Phytophthora cactorum, Phytophthora phaseoli, Phytophthora parasitica, Phytophthora citrophthora, Phytophthora megasperma* f.sp. *soiae* or *Phytophthora infestans*) causing e.g. late blight in potato and tomato; *Puccinia* spp. (e.g. *Puccinia sorghi, Puccinia striiformis* (yellow rust), *Puccinia graminis* f.sp. *tritici, Puccinia asparagi, Puccinia recondita* or *Puccinia arachidis*) causing e.g. common rust in corn; *Rhizoctonia* spp. (e.g. *Rhizoctonia solani, Rhizoctonia oryzae* or *Rhizoctonia cerealis*) causing e.g. sheath blight in rice or early blight in potato; *Rhizopus* spp. (e.g. *Rhizopus chinensid*) causing seedling blight; *Trichoderma* spp. (e.g. *Trichoderma virde*) causing seedling blight; or *Verticillium* spp. (e.g. *Verticillium dahliae* or *Verticillium albo-atrum*) causing e.g. verticillium wilt in cotton.

Particularly preferred plant pathogenic fungi according to the invention are *Magnaporthe oryzae* causing e.g. rice blast; *Rhizoctonia* spp. (e.g. *Rhizoctonia solani, Rhizoctonia oryzae* or *Rhizoctonia cerealis*) causing e.g. sheath blight in rice; *Curvularia* spp., *Rhizopus* spp. (e.g. *Rhizopus chinensid*), *Trichoderma* spp. (e.g. *Trichoderma virde*) causing seedling blight in rice; *Phakopsora* spp. causing e.g. soybean rust; Phytophthora spp. (e.g. *Phytophthora cinnamomi, Phytophthora cactorum, Phytophthora phaseoli, Phytophthora parasitica, Phytophthora citrophthora, Phytophthora megasperma* f.sp. *soiae* or *Phytophthora infestans*) causing e.g. late blight in tomato and potato; *Cercospora* spp. (e.g. *Cercospora kikuchii* or *Cercospora zaea-maydis*) or *Mycosphaerella* spp. causing e.g. black and yellow sigatoka in banana; or *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*) causing e.g. Panama disease in banana.

A particularly preferred plant pathogenic fungus is *Magnaporthe oryzae* causing rice blast.

The fungal cell may be an intact fungal cell, meaning that the fungal cell has a cell wall. In this non-limiting embodiment, the fungal cell is contacted with double-stranded RNA by contacting the intact fungal cell with the double-stranded RNA. The cell wall of the fungal cell need not be removed prior to contact with the double-stranded RNA. Thus, when the fungal cell has a cell wall, the method of the invention comprises contacting the fungal cell with at least one double-stranded RNA, wherein the dsRNA is added or contacted outside of the fungal cell and external to the cell wall of the fungal cell, wherein the double-stranded RNA comprises annealed complementary strands, one of which has a nucleotide sequence which corresponds to a target nucleotide sequence of a target fungal gene to be down-regulated. The dsRNA is taken up by the fungal cell(s) through the cell wall.

The term "fungal cell" encompasses fungal cells of all types and at all stages of development, including specialised reproductive cells such as sexual and asexual spores. As used herein the fungal cell encompasses the fungus as such and also other life forms of the fungus, such as haustoria, conidia, mycelium, penetration peg, spore, zoospores etc.

In cases where fungi reproduce both sexually and asexually, these fungi have two names: the teleomorph name describes the fungus when reproducing sexually; the anamorph name refers to the fungus when reproducing asexually. The holomorph name refers to the "whole fungus", encompassing both reproduction methods. When referring to one of these names in this invention, the "whole" fungus is referred to.

According to one embodiment of the present invention, the fungal cell which is contacted with the dsRNA is a plant pathogenic fungal cell in a life stage outside a plant cell, for example in the form of a hypha, germ tube, appressorium, conidium (asexual spore), ascocarp, cleistothecium, or ascospore (sexual spore outside the plant).

According to another embodiment of the present invention, the fungal cell which is contacted with the dsRNA is a plant pathogenic fungal cell in a life stage inside a plant cell, for example a pathogenic form such as a penetration peg, a hypha, a spore or a haustorium.

The present invention relates to any gene of interest in the fungus (which may be referred to herein as the "target gene") that can be down-regulated. These can be coding or noncoding genes.

The terms "down-regulation of gene expression" and "inhibition of gene expression" are used interchangeably and refer to a measurable or observable reduction in gene expression or a complete abolition of detectable gene expression, at the level of protein product and/or mRNA product from the target gene, or at the level of phenotype. Down-regulation or inhibition of gene expression is "specific" when down-regulation or inhibition of the target gene occurs without manifest effects on other genes of the fungal cell. The down-regulation effect of the dsRNA on gene expression may be calculated as being at least 30%, 40%, 50%, 60%, preferably 70%, 80% or even more preferably 90% or 95% when compared with normal gene expression.

Depending on the nature of the target gene, down-regulation or inhibition of gene expression in cells of a fungus can be confirmed by phenotypic analysis of the cell or the whole fungus or by measurement of mRNA or protein expression using molecular techniques such as RNA solution hybridization, PCR, nuclease protection, Northern hybridization, reverse transcription, gene expression monitoring with a microarray, antibody binding, enzyme linked immunosorbent assay (ELISA), Western blotting, radioimmunoassay (RIA), other immunoassays, or fluorescence activated cell analysis (FACS).

The "target gene" may be essentially any gene that it is desirable to be inhibited because it interferes with growth or pathogenicity or infectivity of the fungus. For instance if the method of the invention is to be used to prevent fungal growth and/or infestation then it is preferred to select a target gene which is essential for viability, growth, development or reproduction of the fungus, or any gene that is involved with pathogenicity or infectivity of the fungus, such that specific inhibition of the target gene leads to a lethal phenotype or decreases or stops fungal infestation.

According to one non-limiting embodiment, the target gene is such that when its expression is down-regulated or inhibited using the method of the invention, the fungal cell is killed, or the reproduction or growth of the fungal cell is stopped or retarded. This type of target genes is considered to be essential for the viability of the fungus cell(s) and is referred to as essential genes. Therefore, the present invention encompasses a method as described herein, wherein the target gene is an essential gene.

Particular essential target genes suitable for the methods of the present invention, are genes involved in essential cellular functions that maintain cell viability, cell growth and development, and reproduction. Examples of still other suitable target genes involved in different cellular processes are described in Tables 1 and 2.

According to a further non-limiting embodiment, the target gene is such that when it is down-regulated using the method of the invention, the infestation or infection by the fungus, the damage caused by the fungus, and/or the ability of the fungus to infest or infect host organisms and/or cause such damage, is reduced. The terms “infest” and “infect” or “infestation” and “infection” are generally used interchangeably throughout. This type of target genes is considered to be involved in the pathogenicity or infectivity of the fungus. Therefore, the present invention extends to methods as described herein, wherein the target gene is involved in the pathogenicity or infectivity of the fungus, preferably the fungal target gene is involved in the formation of germ tubes, conidia attachment, formation of appressoria, formation of the penetration peg or formation of conidia. The advantage of choosing the latter type of target gene is that the fungus is blocked to infect further plants or plant parts and to form further generations. A further advantage of using a target gene involved in pathogenicity or infectivity is that the dsRNA can be taken up by the fungus when it is growing inside the plant, so that the spores formed are unable to infect further plant parts.

According to one embodiment, target genes are conserved genes or fungus-specific genes.

Some preferred, but non-limiting, examples of suitable target genes are listed in Tables 1 and 2.

The invention thus relates to RNAi-mediated down-regulation or inhibition of one or more of the *Magnaporthe grisea* target genes listed above in Table 1, and also to down-regulation of the homologous/orthologous target genes in other fungal species as listed in Table 2. Therefore, the present invention extends to methods as described herein wherein the fungal target gene is involved in any of the cellular functions as defined in Table 1 (rightmost column). A non-limiting example is for instance a method as described herein wherein the fungal target gene is a gene involved in the function of a ribosome, proteasome, spliceosome, APC complex; or a gene involved in nuclear transport, translation initiation, transcription (e.g. transcription activation), intracellular membrane traffic, DNA replication, mitotic spindle formation, vesicle transport or the cytoskeleton.

In addition, any suitable double-stranded RNA or nucleotide fragment capable of directing RNAi or RNA-mediated gene silencing or inhibition of a fungal target gene may be used in the methods of the invention.

In the methods of the present invention, dsRNA is used to inhibit growth or to interfere with the pathogenicity or infectivity of the fungus.

The invention thus relates to isolated double-stranded RNA comprising annealed complementary strands, one of which has a nucleotide sequence which is complementary to at least part of a target nucleotide sequence of a target gene of a fungus. The target gene may be any of the target genes described herein, or a part thereof that exerts the same function. According to one embodiment of the present invention, an isolated double-stranded RNA is provided comprising annealed complementary strands, one of which has a nucleotide sequence which is complementary to at least part of a nucleotide sequence of a fungal target gene, wherein said fungal target gene is essential for the viability, growth, development or reproduction of the fungus, preferably said fungal target gene is involved in any of the cellular functions as defined in Table 1; or wherein said fungal target gene is involved in the pathogenicity or infectivity of the fungus, preferably said fungal target gene is involved in the formation of germ tubes, conidia attachment, formation of appressoria, formation of the penetration peg or formation of conidia, said nucleotide sequence being capable of inhibiting expression of the target gene. According to one embodiment the present invention relates to an isolated double-stranded RNA comprising annealed complementary strands, one of which has a nucleotide sequence which is complementary to at least part of a nucleotide sequence of a fungal target gene, wherein said target gene comprises a sequence which is selected from the group comprising: (i) sequences which are at least 75%, at least 80% or 85% identical, preferably at least 90%, 95%, 96%, or more preferably at least 97%, 98% and still more preferably at least 99% identical to a sequence represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859 or the complement thereof, and (ii) sequences comprising at least 17, preferably at least 18, 19, 20 or 21, more preferably at least 22, 23 or 24 contiguous nucleotides of any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859 or the complement, or wherein said target gene is an orthologue of a gene comprising at least 17 contiguous nucleotides of any of SEQ ID NOs 562 to 859, or the complement thereof.

Depending on the assay used to measure gene silencing, the growth inhibition can be quantified as being greater than about 5%, 10%, more preferably about 20%, 25%, 33%, 50%, 60%, 75%, 80%, most preferably about 90%, 95%, or about 99% as compared to a target cell that has been treated by control dsRNA.

According to another embodiment of the present invention, an isolated double-stranded RNA is provided, wherein at least one of said annealed complementary strands comprises the RNA equivalent of at least one of the nucleotide sequences represented by any of SEQ ID NOs 99, 100, 527, 111, 112, 113, 114, 115, 116, 117, 536, 537, 538, 101, 102, 528, 97, 98, 526, 124, 106, 531, 109, 534, 126, 119, 127, 103, 104, 105, 529, 118, 108, 533, 121, 125, 123, 107, 532, 122, 120, 110, 535, 530, 539, 540, 541, 542, 543, 544, 545, 546, 547, 548, 549, 550, 551, 552 and 562 to 859, or the RNA equivalent of a fragment of at least 17, preferably at least 18, 19, 20 or 21, more preferably at least 22, 23 or 24 basepairs in length thereof. Preferably said isolated double-stranded RNA comprises the RNA equivalent of at least one of the nucleotide sequences represented by any of SEQ ID NOs 192, 201, 202, 193, 190, 191, 196, 199, 200, 194, 195, 198 and 197, or a double-stranded fragment of 17, preferably at least 18, 19, 20 or 21, more preferably at least 22, 23 or 24 basepairs in length thereof. According to another embodiment of the present invention, an isolated double-stranded RNA is provided comprising annealed complementary strands, one of which has a nucleotide sequence which is complementary to at least part of a nucleotide sequence of a fungal target, for use as a medicament. According to another embodiment of the present invention the use as a medicament is provided for the isolated double-stranded RNA as described above.

If the method of the invention is used for controlling growth or infestation of fungus in or on a host cell or host organism, it is preferred that the double-stranded RNA does not share any significant homology with any host gene, or at least not with any essential gene of the host. In this context, it is preferred that the double-stranded RNA shows less than 30%, more preferably less that 20%, more preferably less than 10%, and even more preferably less than 5% nucleic acid sequence identity with any gene of the host cell. % sequence identity should be calculated across the full length of the double-stranded RNA region. If genomic sequence data, preferentially transcriptome data, is available for the host organism one may cross-check sequence identity with the double-stranded RNA using standard bioinformatics tools. In one embodiment, there is no sequence identity between the dsRNA and a host sequences over 21 contiguous nucleotides, meaning that in this context, it is preferred that 21 contiguous base pairs of the dsRNA do not occur in the genome of the host organism. In another embodiment, there is less than about 10% or less than about 12.5% sequence identity over 24 contiguous nucleotides of the dsRNA with any nucleotide sequence from a host species.

The double-stranded RNA comprises annealed complementary strands, one of which has a nucleotide sequence which corresponds to a target nucleotide sequence of the target gene to be down-regulated. The other strand of the double-stranded RNA is able to base-pair with the first strand.

The expression "target region" or "target nucleotide sequence" of the target fungal gene may be any suitable region or nucleotide sequence of the gene. The target region should comprise at least 17, at least 18 or at least 19 consecutive nucleotides of the target gene, more preferably at least 20 or at least 21 nucleotide and still more preferably at least 22, 23 or 24 nucleotides of the target gene.

It is preferred that (at least part of) the double-stranded RNA will share 100% sequence identity with the target region of the fungal target gene. However, it will be appreciated that 100% sequence identity over the whole length of the double-stranded region is not essential for functional RNA inhibition. RNA sequences with insertions, deletions, and single point mutations relative to the target sequence have also been found to be effective for RNA inhibition. The terms "corresponding to" or "complementary to" are used herein interchangeable, and when these terms are used to refer to sequence correspondence between the double-stranded RNA and the target region of the target gene, they are to be interpreted accordingly, i.e. as not absolutely requiring 100% sequence identity. However, the % sequence identity between the double-stranded RNA and the target region will generally be at least 80% or 85% identical, preferably at least 90%, 95%, 96%, or more preferably at least 97%, 98% and still more preferably at least 99% identical.

The term "complementary" as used herein relates to both DNA-DNA complementarity as to DNA-RNA complementarity. In analogy herewith, the term "RNA equivalent" substantially means that in the DNA sequence(s), the base "T" may be replaced by the corresponding base "U" normally present in ribonucleic acids.

Although the dsRNA contains a sequence which corresponds to the target region of the target gene it is not absolutely essential for the whole of the dsRNA to correspond to the sequence of the target region. For example, the dsRNA may contain short non-target regions flanking or inserted into the target-specific sequence, provided that such sequences do not affect performance of the dsRNA in RNA inhibition to a material extent.

The dsRNA may contain one or more substitute bases in order to optimise performance in RNAi. Substitution of even a single nucleotide may have an effect on activity of the dsRNA in RNAi. It will be apparent to the skilled reader how to vary each of the bases of the dsRNA in turn and test the activity of the resulting siRNAs (e.g. in a suitable in vitro test system) in order to optimise the performance of a given dsRNA.

The dsRNA may further contain DNA bases, non-natural bases or non-natural backbone linkages or modifications of the sugar-phosphate backbone, for example to enhance stability during storage or enhance resistance to degradation by nucleases.

It has been previously reported that the formation of short interfering RNAs (siRNAs) of about 21 bp is desirable for effective gene silencing. However, in applications of applicant it has been shown that the minimum length of dsRNA preferably is at least about 80-100 bp in order to be efficiently taken up by certain pest organisms. There are indications that in invertebrates such as the free living nematode *C. elegans* or the plant parasitic nematode *Meloidogyne incognita*, these longer fragments are more effective in gene silencing, possibly due to a more efficient uptake of these long dsRNA by the invertebrate.

It has also recently been suggested that synthetic RNA duplexes consisting of either 27-mer blunt or short hairpin (sh) RNAs with 29 bp stems and 2-nt 3' overhangs are more potent inducers of RNA interference than conventional 21-mer siRNAs. Thus, molecules based upon the targets identified above and being either 27-mer blunt or short hairpin (sh) RNA's with 29-bp stems and 2-nt 3' overhangs are also included within the scope of the invention.

Therefore, in one embodiment, the double-stranded RNA fragment (or region) will itself preferably be at least 17 bp in length, preferably 18 or 19 bp in length, more preferably at least 20 bp, more preferably at least 21 bp, or at least 22 bp, or at least 23 bp, or at least 24 bp, 25 bp, 26 bp or at least 27 bp in length. The expressions "double-stranded RNA fragment" or "double-stranded RNA region" refer to a small entity of the double-stranded RNA corresponding with (part of) the target gene.

Generally, the double-stranded RNA is preferably between about 17-1500 bp, even more preferably between about 80-1000 bp and most preferably between about 17-27 bp or between about 80-250 bp; such as double-stranded RNA regions of about 17 bp, 18 bp, 19 bp, 20 bp, 21 bp, 22 bp, 23 bp, 24 bp, 25 bp, 27 bp, 50 bp, 80 bp, 100 bp, 150 bp, 200 bp, 250 bp, 300 bp, 350 bp, 400 bp, 450 bp, 500 bp, 550 bp, 600 bp, 650 bp, 700 bp, 900 bp, 100 bp, 1100 bp, 1200 bp, 1300 bp, 1400 bp or 1500 bp.

The upper limit on the length of the double-stranded RNA may be dependent on i) the requirement for the dsRNA to be taken up by the fungal cell and ii) the requirement for the dsRNA to be processed within the cell into fragments that direct RNAi. The chosen length may also be influenced by the method of synthesis of the RNA and the mode of delivery of the RNA to the cell. Preferably the double-stranded RNA to be used in the methods of the invention will be less than 10,000 bp in length, more preferably 1000 bp or less more preferably 500 bp or less, more preferably 300 bp or less, more preferably 100 bp or less. For any given target gene and fungus, the optimum length of the dsRNA for effective inhibition may be determined by experiment.

The double-stranded RNA may be fully or partially double-stranded. Partially double-stranded RNAs may include short single-stranded overhangs at one or both ends of the double-stranded portion, provided that the RNA is still capable of being taken up by fungal cells and directing RNAi.

The methods of the invention can encompass simultaneous or sequential provision of two or more different double-stranded RNAs or RNA constructs to the same fungal cell, so as to achieve down-regulation or inhibition of multiple target genes or to achieve a more potent inhibition of a single target gene.

Alternatively, multiple targets are hit by the provision of one double-stranded RNA that hits multiple target sequences, and a single target is more efficiently inhibited by the presence of more than one copy of the double-stranded RNA fragment corresponding to the target gene. Thus, in one embodiment of the invention, the double-stranded RNA construct comprises multiple dsRNA regions, at least one strand of each dsRNA region comprising a nucleotide sequence that is complementary to at least part of a target nucleotide sequence of a fungal target gene. According to the invention, the dsRNA regions in the RNA construct may be complementary to the same or to different target genes and/or the dsRNA regions may be complementary to targets from the same or from different fungus species. Use of such dsRNA constructs in a plant host cell, thus establishes a more potent resistance to a single or to multiple fungal species in the plant.

The terms "hit", "hits" and "hitting" are alternative wordings to indicate that at least one of the strands of the dsRNA is complementary to, and as such may bind to, the target gene or nucleotide sequence.

In one embodiment, the double-stranded RNA region comprises multiple copies of the nucleotide sequence that is complementary to the target gene. Alternatively, the dsRNA hits a further target sequence of the same target gene. The invention thus encompasses isolated double-stranded RNA constructs comprising at least two copies of said nucleotide sequence complementary to at least part of a nucleotide sequence of a fungal target. In another embodiment the invention relates to an isolated double-stranded RNA construct comprising at least two copies of the RNA equivalent of at least one of the nucleotide sequences represented by any of SEQ ID NOs 99, 100, 527, 111, 112, 113, 114, 115, 116, 117, 536, 537, 538, 101, 102, 528, 97, 98, 526, 124, 106, 531, 109, 534, 126, 119, 127, 103, 104, 105, 529, 118, 108, 533, 121, 125, 123, 107, 532, 122, 120, 110, 535, 530, 539, 540, 541, 542, 543, 544, 545, 546, 547, 548, 549, 550, 551, 552 and 562 to 859, or comprising at least two copies of the RNA equivalent of a fragment of at least 17 basepairs in length thereof, preferably at least 18, 19, 20 or 21, more preferably at least 22, 23 or 24 basepairs in length thereof.

The term "multiple" in the context of the present invention means at least two, at least three, at least four, at least five, at least six, etc.

The expressions "a further target gene" or "at least one other target gene" mean for instance a second, a third or a fourth, etc. target gene.

DsRNA that hits more than one of the above-mentioned targets, or a combination of different dsRNA against different of the above mentioned targets may be developed or used in the methods of the present invention.

Accordingly the invention relates to an isolated double-stranded RNA construct comprising at least two copies of the RNA equivalent of at least one of the nucleotide sequences represented by any of SEQ ID NOs 99, 100, 527, 111, 112, 113, 114, 115, 116, 117, 536, 537, 538, 101, 102, 528, 97, 98, 526, 124, 106, 531, 109, 534, 126, 119, 127, 103, 104, 105, 529, 118, 108, 533, 121, 125, 123, 107, 532, 122, 120, 110, 535, 530, 539, 540, 541, 542, 543, 544, 545, 546, 547, 548, 549, 550, 551, 552 and 562 to 859, or comprising at least one double-stranded fragment of at least 17, preferably at least 18, 19, 20 or 21, more preferably at least 22, 23 or 24 basepairs in length thereof. Preferably, said double-stranded RNA comprises the RNA equivalent of the nucleotide sequence as represented in SEQ ID NO 117, or a double-stranded fragment of at least 17, preferably at least 18, 19, 20 or 21, more preferably at least 22, 23 or 24 basepairs in length thereof.

Accordingly, the present invention extends to methods as described herein, wherein the dsRNA comprises annealed complementary strands, one of which has a nucleotide sequence which is complementary to at least part of a target nucleotide sequence of a fungal target gene, and which comprises at least one additional dsRNA region, at least one strand of which comprises a nucleotide sequence which is complementary to at least part of the nucleotide sequence of at least one other fungal target gene. Such further target gene may be any of the target genes herein described. According to one preferred embodiment the dsRNA hits at least one target gene that is essential for viability, growth, development or reproduction of the fungus and hits at least one gene involved in pathogenicity or infectivity as described hereinabove. Alternatively, the dsRNA hits multiple genes of the same category, for example, the dsRNA hits at least 2 essential genes or at least 2 genes involved in pathogenicity or at least two genes involved in any of the cellular functions as described in Table 1.

Accordingly, the present invention extends to methods as described herein, wherein the dsRNA comprises annealed complementary strands, one of which has a nucleotide sequence which is complementary to at least part of a target nucleotide sequence of a fungal target gene, and which comprises the RNA equivalents of at least two nucleotide sequences independently chosen from each other. In one embodiment, the dsRNA comprises the RNA equivalents of at least two, preferably at least three, four or five, nucleotide sequences independently chosen from the sequences represented by any of SEQ ID Nos 99, 100, 527, 111, 112, 113, 114, 115, 116, 117, 536, 537, 538, 101, 102, 528, 97, 98, 526, 124, 106, 531, 109, 534, 126, 119, 127, 103, 104, 105, 529, 118, 108, 533, 121, 125, 123, 107, 532, 122, 120, 110, 535, 530, 539, 540, 541, 542, 543, 544, 545, 546, 547, 548, 549, 550, 551, 552 and 562 to 859, or fragments thereof of at least 17 basepairs in length, preferably at least 18, 19, 20 or 21, more preferably at least 22, 23 or 24 basepairs in length thereof.

The at least two nucleotide sequences may be derived from the target genes herein described. According to one preferred embodiment the dsRNA hits at least one target gene that is essential for viability, growth, development or reproduction of the nematode and hits at least one gene involved in pathogenicity or infectivity as described hereinabove. Alternatively, the dsRNA hits multiple genes of the same category, for example, the dsRNA hits at least 2 essential genes or at least 2 genes involved in the same cellular function.

According to a further embodiment, the dsRNA hits at least 2 target genes, which target genes are involved in a different cellular function chosen from those functions as described in Table 1. For example the dsRNA hits two or more genes involved in protein synthesis (e.g. ribosome subunits), protein degradation (e.g. proteasome subunits), formation of microtubule cytoskeleton (e.g. beta-tubulin gene) such as the genes shown in FIGS. 3A-3MM.

The dsRNA regions (or fragments) in the double-stranded RNA may be combined as follows:

a) when multiple dsRNA regions targeting a single target gene are combined, they may be combined in the original order (ie the order in which the regions appear in the target gene) in the RNA construct, b) alternatively, the original order of the fragments may be ignored so that they are scrambled and combined randomly or deliberately in any order into the double-stranded RNA construct, c) alternatively, one single fragment may be repeated several times, for example from 1 to 10 times, e.g. 1, 2, 3, 4, 5, 6, 7, 8, 9 or 10 times, in the ds RNA construct, or d) the dsRNA regions (targeting a single or different target genes) may be combined in the sense or antisense orientation.

In addition, the target gene(s) to be combined may be chosen from one or more of the following categories of genes:

e) "essential" genes or "pathogenicity genes" as described above encompass genes that are vital for one or more target fungi and result in a lethal or severe (e.g. feeding, reproduction, growth) phenotype when silenced. The choice of a strong lethal target gene results in a potent RNAi effect. In the RNA constructs of the invention, multiple dsRNA regions targeting the same or different (very effective) lethal genes can be combined to further increase the potency, efficacy or speed of the RNAi effect in fungal control.

f) "weak" genes encompass target genes with a particularly interesting function in one of the cellular pathways described herein, but which result in a weak phenotypic effect when silenced independently. In the RNA constructs of the invention, multiple dsRNA regions targeting a single or different weak gene(s) may be combined to obtain a stronger RNAi effect.

g) "fungus specific" genes encompass genes that have no substantial homologous counterpart in non-fungus organisms as can be determined by bioinformatics homology searches, for example by BLAST searches. The choice of a fungal specific target gene results in a species specific RNAi effect, with no effect or no substantial (adverse) effect in non-target organisms.

h) "conserved genes" encompass genes that are conserved (at the amino acid level) between the target organism and non-target organism(s). To reduce possible effects on non-target species, such effective but conserved genes are analysed and target sequences from the variable regions of these conserved genes are chosen to be targeted by the dsRNA regions in the RNA construct. Here, conservation is assessed at the level of the nucleic acid sequence. Such variable regions thus encompass the least conserved sections, at the level of the nucleic acid sequence, of the conserved target gene(s).

i) "conserved pathway" genes encompass genes that are involved in the same biological pathway or cellular process, or encompass genes that have the same functionality in different fungus species resulting in a specific and potent RNAi effect and more efficient fungus control;

j) alternatively, the RNA constructs according to the present invention target multiple genes from different biological pathways, resulting in a broad cellular RNAi effect and more efficient fungal control.

According to the invention, all double-stranded RNA regions comprise at least one strand that is complementary to at least part or a portion of the nucleotide sequence of any of the target genes herein described.

However, provided that one of the double-stranded RNA regions comprises at least one strand that is complementary to a portion of the nucleotide sequence of any one of the target genes herein described, the other double-stranded RNA regions may comprise at least one strand that is complementary to a portion of any other fungal target gene (including known target genes).

In one embodiment of the present invention, there is provided an isolated double-stranded RNA or RNA construct for use as a medicament.

According to yet another embodiment of the present invention, there is provided an isolated double-stranded RNA or RNA construct, further comprising at least one additional sequence and optionally a linker. In one embodiment, the additional sequence is chosen from the group comprising (i) a sequence facilitating large-scale production of the dsRNA construct; (ii) a sequence effecting an increase or decrease in the stability of the dsRNA; (iii) a sequence allowing the binding of proteins or other molecules to facilitate uptake of the RNA construct by a fungal cell(s); (iv) a sequence which is an aptamer that binds to a receptor or to a molecule on the surface or in the cytoplasm of a fungal cell(s) to facilitate uptake, endocytosis and/or transcytosis by the fungal cell(s); or (v) additional sequences to catalyze processing of dsRNA regions. In one embodiment, the linker is a conditionally self-cleaving RNA sequence, preferably a pH sensitive linker or a hydrophobic sensitive linker. In one embodiment, the linker is an intron.

In one embodiment, the multiple dsRNA regions of the double-stranded RNA construct are connected by one or more linkers. In another embodiment, the linker is present at a site in the RNA construct, separating the dsRNA regions from another region of interest. Different linker types for the dsRNA constructs are provided by the present invention.

In another embodiment, the multiple dsRNA regions of the double-stranded RNA construct are connected without linkers.

In a particular embodiment of the invention, the linkers may be used to disconnect smaller dsRNA regions in the pest organism. Advantageously, in this situation the linker sequence may promote division of a long dsRNA into smaller dsRNA regions under particular circumstances, resulting in the release of separate dsRNA regions under these circumstances and leading to more efficient gene silencing by these smaller dsRNA regions. Examples of suitable conditionally self-cleaving linkers are RNA sequences that are self-cleaving at high pH conditions. Suitable examples of such RNA sequences are described by Borda et al. (Nucleic Acids Res. 2003 May 15; 31(10):2595-600), which document is incorporated herein by reference. This sequence originates from the catalytic core of the hammerhead ribozyme HH16.

In another aspect of the invention, a linker is located at a site in the RNA construct, separating the dsRNA regions from another, e.g. the additional, sequence of interest, which preferably provides some additional function to the RNA construct.

In one particular embodiment of the invention, the dsRNA constructs of the present invention are provided with an aptamer to facilitate uptake of the dsRNA by the fungus. The aptamer is designed to bind a substance which is taken up by the fungus. Such substances may be from a fungal or plant origin. One specific example of an aptamer, is an aptamer that binds to a transmembrane protein, for example a transmembrane protein of a fungus. Alternatively, the aptamer may bind a (plant) metabolite or nutrient which is taken up by the fungus.

Alternatively, the linkers are self-cleaving in the endosomes. This may be advantageous when the constructs of the present invention are taken up by the fungus via endocytosis or transcytosis, and are therefore compartmentalized in the endosomes of the fungus species. The endosomes may have a low pH environment, leading to cleavage of the linker.

The above mentioned linkers that are self-cleaving in hydrophobic conditions are particularly useful in dsRNA constructs of the present invention when used to be transferred from one cell to another via the transit in a cell wall, for example when crossing the cell wall of a fungus pest organism.

An intron may also be used as a linker. An "intron" as used herein may be any non-coding RNA sequence of a messenger RNA. Particular suitable intron sequences for the constructs of the present invention are (1) U-rich (35-45%); (2) have an average length of 100 bp (varying between about 50 and about 500 bp) which base pairs may be randomly chosen or may be based on known intron sequences; (3) start at the 5' end with -AG:GT- or -CG:GT- and/or (4) have at their 3' end -AG:GC- or -AG:AA.

A non-complementary RNA sequence, ranging from about 1 base pair to about 10,000 base pairs, may also be used as a linker.

Without wishing to be bound by any particular theory or mechanism, it is thought that long double-stranded RNAs added externally to a fungal cell are taken up into the cell by the natural mechanisms by which fungal cells take up material from their immediate environment, such as for example pathways of endocytosis. Double-stranded RNAs taken up into the cell are then processed within the cell into short double-stranded RNAs, called small interfering RNAs (siRNAs), by the action of an endogenous endonuclease. The resulting siRNAs then mediate RNAi via formation of a multi-component RNase complex termed the RISC or RNA interfering silencing complex.

In order to achieve down-regulation of a target gene within a fungal cell the double-stranded RNA added to the exterior of the cell wall may be any dsRNA or dsRNA construct that can be taken up into the cell and then processed within the cell into siRNAs, which then mediate RNAi, or the RNA added to the exterior of the cell could itself be an siRNA that can be taken up into the cell and thereby direct RNAi.

siRNAs are generally short double-stranded RNAs having a length in the range of from 19 to 25 base pairs, or from 20 to 24 base pairs. In preferred embodiments siRNAs having 19, 20, 21, 22, 23, 24 or 25 base pairs, and in particular 21 or 22 base pairs, corresponding to the target gene to be down-regulated may be used. However, the invention is not intended to be limited to the use of such siRNAs.

siRNAs may include single-stranded overhangs at one or both ends, flanking the double-stranded portion. In a particularly preferred embodiment the siRNA may contain 3' overhanging nucleotides, preferably two 3' overhanging thymidines (dTdT) or uridines (UU). 3' TT or UU overhangs may be included in the siRNA if the sequence of the target gene immediately upstream of the sequence included in double-stranded part of the dsRNA is AA. This allows the TT or UU overhang in the siRNA to hybridise to the target gene. Although a 3' TT or UU overhang may also be included at the other end of the siRNA it is not essential for the target sequence downstream of the sequence included in double-stranded part of the siRNA to have AA. In this context, siRNAs which are RNA/DNA chimeras are also contemplated. These chimeras include, for example, the siRNAs comprising a double-stranded RNA with 3' overhangs of DNA bases (e.g. dTdT), as discussed above, and also double-stranded RNAs which are polynucleotides in which one or more of the RNA bases or ribonucleotides, or even all of the ribonucleotides on an entire strand, are replaced with DNA bases or deoxynucleotides.

The dsRNA may be formed from two separate (sense and antisense) RNA strands that are annealed together by (non-covalent) basepairing. Alternatively, the dsRNA may have a foldback stem-loop or hairpin structure, wherein the two annealed strands of the dsRNA are covalently linked. In this embodiment the sense and antisense stands of the dsRNA are formed from different regions of single polynucleotide molecule that is partially self-complementary. RNAs having this structure are convenient if the dsRNA is to be synthesised by expression in vivo, for example in a host cell or organism as discussed below, or by in vitro transcription. The precise nature and sequence of the "loop" linking the two RNA strands is generally not material to the invention, except that it should not impair the ability of the double-stranded part of the molecule to mediate RNAi. The features of "hairpin" or "stem-loop" RNAs for use in RNAi are generally known in the art (see for example WO 99/53050, in the name of CSIRO, the contents of which are incorporated herein by reference). In other embodiments of the invention, the loop structure may comprise linker sequences or additional sequences as described above.

The double-stranded RNA or construct may be prepared in a manner known per se. For example, double-stranded RNAs may be synthesised in vitro using chemical or enzymatic RNA synthesis techniques well known in the art. In one approach the two separate RNA strands may be synthesised separately and then annealed to form double-strands. In a further embodiment, double-stranded RNAs or constructs may be synthesised by intracellular expression in a host cell or organism from a suitable expression vector. This approach is discussed in further detail below.

The amount of double-stranded RNA with which the fungal cell is contacted is such that specific down-regulation of the one or more target genes is achieved. The RNA may be introduced in an amount which allows delivery of at least one copy per cell. However, in certain embodiments higher doses (e.g., at least 5, 10, 100, 500 or 1000 copies per cell) of double-stranded RNA may yield more effective inhibition. For any given fungal gene target the optimum amount of dsRNA for effective inhibition may be determined by routine experimentation.

The fungal cell may be contacted with the double-stranded RNA in any suitable manner, permitting direct uptake of the double-stranded RNA by the fungus. For example, the fungal cell can be contacted with the double-stranded RNA in pure or substantially pure form, for example an aqueous solution containing the dsRNA. In this embodiment, the fungus may be simply "soaked" with an aqueous solution comprising the double-stranded RNA. In a further embodiment the fungal cell can be contacted with the double-stranded RNA by spraying the fungal cell with a liquid composition comprising the double-stranded RNA.

Alternatively, the double-stranded RNA may be linked to a food component of the fungi, such as a food component for a mammalian pathogenic fungus, in order to increase uptake of the dsRNA by the fungus.

In other embodiments the fungal cell may be contacted with a composition containing the double-stranded RNA. The composition may, in addition to the dsRNA, contain further excipients, diluents or carriers. Preferred features of such compositions are discussed in more detail below.

The double-stranded RNA may also be incorporated in the medium in which the fungus grows or in or on a material or substrate that is infested by the fungus or impregnated in a substrate or material susceptible to infestation by fungus.

Another aspect of the present invention are target nucleotide sequences of the fungal target genes herein disclosed. Such target nucleotide sequences are particularly important to design the dsRNA constructs according to the present invention. Such target nucleotide sequences are preferably at least 17, preferably at least 18, 19, 20 or 21, more preferably at least 22, 23 or 24 nucleotides in length. Non-limiting examples of preferred target nucleotide sequences are given in the examples. The present invention encompasses isolated nucleotide sequences consisting of at least one sequence represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499 and 552 and 562 to 859 or the complement thereof, comprising a fragment thereof comprising at least 17, preferably at least 18, 19, 20 or 21, more preferably at least 22, 23 or 24 nucleotides of any of SEQ ID 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499 and 552 and 562 to 859 or the complement thereof.

According to one embodiment, the present invention provides an isolated nucleotide sequence encoding a double-stranded RNA or double-stranded RNA construct as described herein.

According to yet another embodiment, the present invention provides fungal target genes, which comprise a sequence as herein represented by SEQ ID NO 192, 117, 201, 202, 193, 190, 191, 196, 199, 200, 194, 195, 198 and 197, or a fragment thereof of at least 17, preferably at least 18, 19, 20 or 21, more preferably at least 22, 23 or 24 nucleotides thereof, and which target genes are encompassed by the methods of the present invention.

According to a more specific embodiment, the present invention relates to an isolated nucleic acid sequence consisting of a sequence represented by any of SEQ ID NOs 3, 99, 100, 527, 192, 39, 111, 112, 113, 114, 115, 116, 117, 536, 537, 538, 201, 202, 5, 101, 102, 528, 193, 1, 97, 98, 526, 184, 185, 190, 191, 37, 124, 9, 106, 531, 188, 189, 196, 13, 109, 534, 199, 200, 33, 126, 23, 119, 35, 127, 7, 103, 104, 105, 529, 186, 187, 194, 195, 29, 118, 17, 108, 533, 198, 25, 121, 19, 125, 31, 123, 11, 107, 532, 197, 27, 122, 21, 120, 15, 110, 535, 458, 530, 460, 539, 540, 462, 541, 464, 542, 466, 543, 468, 544, 470, 545, 472, 546, 474, 547, 476, 548, 478, 549, 480, 550, 482, 551, 484, 552 and 562 to 859, or a fragment of at least 17 preferably at least 18, 19, 20 or 21, more preferably at least 22, 23 or 24 nucleotides thereof.

A person skilled in the art will recognize that homologues of these target genes can be found and that these homologues are also useful in the methods of the present invention.

Protein, or nucleotide sequences are likely to be homologous if they show a "significant" level of sequence similarity. Truely homologous sequences are related by divergence from a common ancestor gene. Sequence homologues can be of two types: (i) where homologues exist in different species they are known as orthologues. e.g. the α-globin genes in mouse and human are orthologues. (ii) paralogues are homologous genes in within a single species. e.g. the α- and β-globin genes in mouse are paralogues Preferred homologues are genes comprising a sequence which is at least about 85% or 87.5%, still more preferably about 90%, still more preferably at least about 95% and most preferably at least about 99% identical to a sequence selected from the group of sequences represented by SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof. Methods for determining sequence identity are routine in the art and include use of the Blast software and EMBOSS software (*The European Molecular Biology Open Software Suite* (2000), Rice, P. Longden, I. and Bleasby, A. Trends in Genetics 16, (6) pp 276-277). The term "identity" as used herein refers to the relationship between sequences at the nucleotide level. The expression "% identical" is determined by comparing optimally aligned sequences, e.g. two or more, over a comparison window wherein the portion of the sequence in the comparison window may comprise insertions or deletions as compared to the reference sequence for optimal alignment of the sequences. The reference sequence does not comprise insertions or deletions. The reference window is chosen from between at least 10 contiguous nucleotides to about 50, about 100 or to about 150 nucleotides, preferably between about 50 and 150 nucleotides. "% identity" is then calculated by determining the number of nucleotides that are identical between the sequences in the window, dividing the number of identical nucleotides by the number of nucleotides in the window and multiplying by 100.

Other homologues are genes which are alleles of a gene comprising a sequence as represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859. Further preferred homologues are genes comprising at least one single nucleotide polymorphism (SNP) compared to a gene comprising a sequence as represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859.

According to another embodiment, the invention encompasses target genes which are fungal orthologues of a gene comprising any of SEQ ID Nos 206 to 458. Preferred orthologues are represented by any of SEQ ID NOs 206 to 353. More preferred orthologues are represented by any of SEQ ID NOs 206 to 337.

In one embodiment, the present invention relates to any method described herein wherein a nucleic acid is used encoding a protein with an amino acid sequence which is at least 75%, at least 80% or 85% identical, preferably at least 90%, 95%, 96%, or more preferably at least 97%, 98% and still more preferably at least 99% identical to the amino acid sequence as given in SEQ ID NOs 2, 4, 6, 8, 10, 12, 18, 14, 16, 40, 30, 24, 22, 26, 28, 32, 38, 20, 34, 36, 459, 461, 463, 465, 467, 469, 471, 473, 475, 477, 479, 481, 483 and 485.

In another embodiment, the present invention relates to any method described herein wherein a nucleic acid is used encoding a protein with an amino acid sequence which is at least 75%, at least 80% or 85% similar, preferably at least 90%, 95%, 96%, or more preferably at least 97%, 98% and still more preferably at least 99% similar to the amino acid sequence as given in SEQ ID NOs 2, 4, 6, 8, 10, 12, 18, 14, 16, 40, 30, 24, 22, 26, 28, 32, 38, 20, 34, 36, 459, 461, 463, 465, 467, 469, 471, 473, 475, 477, 479, 481, 483 and 485.

The term "similar" or "similarity" with respect to amino acid sequences allows, for instance, conservative amino acid substitutions to be introduced at one or more positions in the amino acid sequences of target polypeptides. A "conservative amino acid substitution" is one in which the amino acid is replaced by another amino acid having a similar structure and/or chemical function. Families of amino acid residues having similar structures and functions are well known. These families include amino acids with basic side chains (e.g. lysine, arginine, histidine), acidic side chains (e.g. aspartic acid, glutamic acid), uncharged polar side chains (e.g., glycine, asparagine, glutamine, serine, threonine, tyrosine, cysteine), nonpolar side chains (e.g. alanine, valine, leucine, isoleucine, praline, phenylalanine, methionine, tryptophan), beta-branched side chains (e.g. threonine, valine, isoleucine) and aromatic side chains (e.g. tyrosine, phenylalanine, tryptophan, histidine). BLAST, BLAST 2.0 and BLAST 2.2.2 algorithms are also used to define "identity" and "similarity" according to the invention. They are described, e.g., in Altschul (1977) Nuc. Acids Res. 25:3389 3402; Altschul (1990) J. Mol. Biol. 215:403-410. Software for performing BLAST analyses is publicly available through the National Center for Biotechnology Information.

In one embodiment, the present invention relates to a nucleic acid which is degenerated to a nucleic acid encoding a protein as given in any of SEQ ID NOs 2, 4, 6, 8, 10, 12, 18, 14, 16, 40, 30, 24, 22, 26, 28, 32, 38, 20, 34, 36, 459, 461, 463, 465, 467, 469, 471, 473, 475, 477, 479, 481, 483 and 485, as a result of the genetic code.

In another embodiment, the present invention relates to a nucleic acid which is diverging from a nucleic acid encoding a protein as given in any of SEQ ID NOs 2, 4, 6, 8, 10, 12, 18, 14, 16, 40, 30, 24, 22, 26, 28, 32, 38, 20, 34, 36, 459, 461, 463, 465, 467, 469, 471, 473, 475, 477, 479, 481, 483 and 485, as a result of differences in codon usage between organisms.

In yet another embodiment, the present invention relates to a nucleic acid which is diverging from a nucleic acid encoding a protein as given in any of SEQ ID NOs 2, 4, 6, 8, 10, 12, 18, 14, 16, 40, 30, 24, 22, 26, 28, 32, 38, 20, 34, 36, 459, 461, 463, 465, 467, 469, 471, 473, 475, 477, 479, 481, 483 and 485, as a result of differences between alleles.

The invention also encompasses target genes which are fungal orthologues of a gene encoding any of the polypeptides of SEQ ID Nos 2, 4, 6, 8, 10, 12, 18, 14, 16, 40, 30, 24, 22, 26, 28, 32, 38, 20, 34, 36, 459, 461, 463, 465, 467, 469, 471, 473, 475, 477, 479, 481, 483 and 485.

According to another embodiment, the invention encompasses target genes which are fungal orthologues of a gene comprising a nucleotide sequence as represented in any of SEQ ID Nos 562 to 746. A non-limiting list of fungal orthologues genes or sequences comprising at least a fragment of 17 nucleotides of one of the sequences of the invention is given in Table 8. By way of example, orthologues may comprise a nucleotide sequence as represented in any of SEQ ID NOs 562 to 746, or a fragment of at least 17, 18, 19, 20, 21, 22, 23, 24, 25, 26 or 27 nucleotides thereof. According to another aspect, the invention thus encompasses any of the methods described herein for controlling fungal growth on a cell or an organism, or for preventing fungal infestation of a cell or an organism susceptible to fungal infection, comprising contacting nematodes with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 562 to 746, whereby the double-stranded RNA is taken up by the fungus and thereby controls growth or prevents infestation. The invention also relates to fungal-resistant transgenic plants comprising a fragment of at least 17, 18, 19, 20 or 21 nucleotides of any of the sequences as represented in SEQ ID NOs 562 to 746. Said fungus may be one of the following non-limiting list of Table 8.

According to another embodiment, the invention encompasses target genes which are nematode orthologues of a gene comprising a nucleotide sequence as represented in any of SEQ ID Nos 747 to 790. A non-limiting list of nematode orthologues genes or sequences comprising at least a fragment of 17 nucleotides of one of the sequences of the invention is given in Table 9. By way of example, orthologues may comprise a nucleotide sequence as represented in any of SEQ ID NOs 747 to 790, or a fragment of at least 17, 18, 19, 20, 21, 22, 23, 24, 25, 26 or 27 nucleotides thereof. According to another aspect, the invention thus encompasses any of the methods described herein for controlling nematode growth in an organism, or for preventing nematode infestation of an organism susceptible to nematode infection, comprising contacting nematodes with double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 747 to 790, whereby the double-stranded RNA is taken up by the nematode and thereby controls growth or prevents infestation. The invention also relates to nematode-resistant transgenic plants comprising a fragment of at least 17, 18, 19, 20 or 21 nucleotides of any of the sequences as represented in SEQ ID NOs 747 to 790. Said nematode may be one of the following non-limiting list of Table 9.

According to another embodiment, the invention encompasses target genes which are insect orthologues of a gene comprising a nucleotide sequence as represented in any of SEQ ID Nos 791 to 859. A non-limiting list of fungal orthologues genes or sequences comprising at least a fragment of 17 nucleotides of one of the sequences of the invention is given in Table 10. By way of example, orthologues may comprise a nucleotide sequence as represented in any of SEQ ID NOs 791 to 859, or a fragment of at least 17, 18, 19, 20, 21, 22, 23, 24, 25, 26 or 27 nucleotides thereof. According to another aspect, the invention thus encompasses any of the methods described herein for controlling insect growth on a cell or an organism, or for preventing insect infestation of a cell or an organism susceptible to insect infection, comprising contacting insects with a double-stranded RNA, wherein the double-stranded RNA comprises annealed complementary strands, one of which has a nucleotide sequence which is complementary to at least part of the nucleotide sequence of a target gene comprising a fragment of at least 17, 18, 19, 20 or 21 nucleotides of any of the sequences as represented in SEQ ID NOs 791 to 859, whereby the double-stranded RNA is taken up by the insect and thereby controls growth or prevents infestation. The invention also relates to insect-resistant transgenic plants comprising a fragment of at least 17, 18, 19, 20 or 21 nucleotides of any of the sequences as represented in SEQ ID NOs 791 to 859. Said insect may be one of the following non-limiting list of Table 10.

In one preferred embodiment of the invention the dsRNA may be expressed by (e.g. transcribed within) a host cell or host organism, the host cell or organism being an organism susceptible or vulnerable to infestation with a fungus. In this embodiment RNAi-mediated gene silencing of one or more target genes in the fungus may be used as a mechanism to control growth of the fungus in or on the host organism and/or to prevent or reduce fungal infestation of the host organism. Thus, expression of the double-stranded RNA within cells of the host organism may confer resistance to a particular fungus or to a class of fungi. In case the dsRNA hits more than one fungal target gene, expression of the double-stranded RNA within cells of the host organism may confer resistance to more than one fungus or more than one class of fungi.

In a preferred embodiment the host organism is a plant and the fungus is a plant pathogenic fungus. In this embodiment the fungal cell is contacted with the double-stranded RNA by expressing the double-stranded RNA in a plant or plant cell that is infested with or susceptible to infestation with the plant pathogenic fungus.

In this context the term "plant" encompasses any plant material that it is desired to treat to prevent or reduce fungal growth and/or fungal infestation. This includes, inter alia, whole plants, seedlings, propagation or reproductive material such as seeds, cuttings, grafts, explants, etc. and also plant cell and tissue cultures. The plant material should express, or have the capability to express, dsRNA corresponding to one or more target genes of the fungus.

Therefore, in a further aspect the invention provides a plant, preferably a transgenic plant, or propagation or reproductive material for a (transgenic) plant, or a plant cell culture expressing or capable of expressing at least one double-stranded RNA, wherein the double-stranded RNA comprises annealed complementary strands, one of which has a nucleotide sequence which is complementary to at least part of a target nucleotide sequence of a target gene of a fungus, such that the double-stranded RNA is taken up by a fungal cell upon plant-fungus interaction, said double-stranded RNA being capable of inhibiting the target gene or down-regulating expression of the target gene by RNA interference. The target gene may be any of the target genes herein described, for instance a target gene that is essential for the viability, growth, development or reproduction of the fungus, preferably said fungal target gene is involved in any of the cellular functions as defined in Table 1; or for instance a fungal target gene that is involved in the pathogenicity or infectivity of the fungus, preferably said fungal target gene is involved in the formation of germ tubes, conidia attachment, formation of appressoria, formation of the penetration peg or formation of conidia.

In this embodiment the fungal cell can be any fungal cell, but is preferably a fungal cell of a plant pathogenic fungus. Preferred plant pathogenic fungi include, but are not limited to, those listed above.

A plant to be used in the methods of the invention, or a transgenic plant according to the invention encompasses any plant, but is preferably a plant that is susceptible to infestation by a plant pathogenic fungus, including but not limited to the following plants: rice, corn, soybean, cotton, potato, banana or tomato, cereals including wheat, oats, barley, rye, vine, apple, pear, sorghum, millet, beans, groundnuts, rapeseed, sunflower, sugarcane. Most preferably the plant is rice, corn, soybean, cotton, potato, banana or tomato.

Accordingly, the present invention extends to methods as described herein wherein the plant is wheat, sorghum, millet, beans, groundnuts, rapeseed, sunflower, sugarcane, rice, corn, soybean, cotton, potato, banana or tomato. In a preferred embodiment the plant is rice, corn, soybean, cotton, potato, banana or tomato.

In one embodiment the present invention extends to methods as described herein, wherein the plant is rice and the target gene is a gene from a fungus selected from the group consisting of: *Magnaporthe* spp. (e.g. *Magnaporthe oryzae* or *Magnaporthe grisae*), *Rhizoctonia* spp. (e.g. *Rhizoctonia solani, Rhizoctonia oryzae* or *Rhizoctonia cerealis*), *Fusarium* spp. (e.g. *Fusarium roseum*), *Acremoniella* spp. (e.g. *Acremoniella atra*), *Pythium* spp. (e.g. *Pythium arrhenomanes, P. myriotylum*, or *P. dissotocum*), *Curvularia* spp. (e.g. *Curvularia oryzae, Curvularia lunatas*), *Trichoderma* spp. (e.g. *Trichoderma virde*) and *Rhizopus* spp. (e.g. *Rhizopus chinensis*); in another embodiment the present invention extends to methods as described herein, wherein the plant is corn and the target gene is a gene from a fungus selected from the group consisting of: *Colletotrichum* spp. (e.g. *Colletotrichum lindemuthianum*), *Gibberella* spp., *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*), *Diplodia* spp. (e.g. *Diplodia maydis*) or *Puccina* spp. (e.g. *Puccinia sorgh, Puccinia striiformis* (causing yellow rust), *Puccinia graminis* f.sp. *tritici, Puccinia asparag, Puccinia recondita* or *Puccinia arachidis*); in another embodiment the present invention extends to methods as described herein, wherein the plant is soybean and the target gene is a gene selected from fungus *Phakopsora* spp. (e.g. *Phakopsora pachyrhizi*); in another embodiment the present invention extends to methods as described herein, wherein the plant is cotton and the target gene is a gene from a fungus selected from the group consisting of *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*) or *Verticillium* spp. (e.g. *Verticillium dahliae* or *Verticillium albo-atrum*); in another embodiment the present invention extends to methods as described herein, wherein the plant is potato and the target gene is a gene from a fungus selected from the group consisting of *Phytophthora* spp. (e.g. *Phytophthora cinnamomi, Phytophthora cactorum, Phytophthora phaseoli, Phytophthora parasitica, Phytophthora citrophthora, Phytophthora megasperma* f.sp. *soiae* or *Phytophthora infestans*), *Rhizoctonia* spp. (e.g. *Rhizoctonia solani, Rhizoctonia oryzae* or *Rhizoctonia cerealis*) or a fungal species that causes wilt, rot or scurf; in another embodiment the present invention extends to methods as described herein, wherein the plant is banana and the target gene is a gene from a fungus selected from the group consisting of *Mycosphaerella* spp., *Cercospora* spp. (e.g. *Cercospora kikuchii* or *Cercospora zaea-maydis*) or *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*); in another embodiment the present invention extends to methods as described herein, wherein the plant is tomato and the target gene is a gene from a fungus selected from the group consisting of *Phytophthora* spp. (e.g. *Phytophthora cinnamom, Phytophthora cactorum, Phytophthora phaseoli, Phytophthora parasitica, Phytophthora citrophthora, Phytophthora megasperma* f.sp. *soiae* or *Phytophthora infestans*) or a fungal species that causes foliar disease, wilt or fruit rot.

In a specific embodiment the plant is rice and the fungus is *Magnaporthe oryzae* causing e.g. rice blast. In another specific embodiment the plant is rice and the fungus is *Rhizoctonia* spp. (e.g. *Rhizoctonia solani, Rhizoctonia oryzae* or *Rhizoctonia cerealis*) causing e.g. sheath blight. In yet another embodiment the plant is rice and the fungus is *Rhizoctonia* spp. (e.g. *Rhizoctonia solani, Rhizoctonia oryzae* or *Rhizoctonia cerealis*), *Fusarium* spp. (e.g. *Fusarium roseum*), *Acremoniella* spp. (e.g. *Acremoniella atra*), *Pythium* spp. (e.g. *Pythium arrhenomanes, P. myriotylum*, or *P. dissotocum*), *Curvularia* spp. (e.g. *Curvularia oryzae, Curvularia lunatas*), *Trichoderma* spp. (e.g. *Trichoderma virde*) or *Rhizopus* spp. (e.g. *Rhizopus chinensis*) causing seedling blight; in another specific embodiment the plant is soybean and the fungus is *Phakopsora* spp. (e.g. *Phaopsora pachyrhizi*) causing e.g. soybean rust; in another specific embodiment the plant is potato and the fungus is *Phytophthora* spp. (e.g. *Phytophthora cinnamomi, Phytophthora cactorum, Phytophthora phaseoli, Phytophthora parasitica, Phytophthora citrophthora, Phytophthora megasperma* f.sp. *soiae* or *Phytophthora infestans*) causing e.g. late blight; in another specific embodiment the plant is banana and the fungus is *Cercospora* spp. (e.g. *Cercospora kikuchii* or *Cercospora zaea-maydis*) or *Mycosphaerella* spp. causing e.g. black and yellow sigatoka. In another specific embodiment the plant is banana and the fungus is *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*) causing e.g. Panama disease; in another specific embodiment the plant is tomato and the fungus is *Phytophthora* spp. (e.g. *Phytophthora cinnamomi, Phytophthora cactorum, Phytophthora phaseoli, Phytophthora parasitica, Phytophthora citrophthora, Phytophthora megasperma* f.sp. *soiae* or *Phytophthora infestans*) causing e.g. late blight; in yet another specific embodiment the plant is corn and the fungus is *Colletotrichum* spp. (e.g. *Colletotrichum lindemuthianum*) causing e.g. anthracnose. In another specific embodiment the plant is corn and the fungus is *Diplodia* spp. (e.g. *Diplodia maydis*), *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*) or *Gibberella* spp. causing e.g. ear, kernel and stalk rots. In another specific embodiment the plant is corn and the fungus is *Puccinia* spp. (e.g. *Puccinia sorghi, Puccinia striiformis, Puccinia graminis* f.sp. *tritici, Puccinia asparagi, Puccinia recondita* or *Puccinia arachidis*) causing e.g. common rust; in another specific embodiment the plant is cotton and the fungus is *Fusarium* spp. (e.g. *Fusarium nivale, Fusarium oxysporum, Fusarium graminearum, Fusarium germinearum, Fusarium culmorum, Fusarium solani, Fusarium moniliforme* or *Fusarium roseum*) causing e.g. *fusarium* wilt. In another specific embodiment the plant is cotton and the fungus is *Verticillium* spp. (e.g. *Verticillium dahliae* or *Verticillium albo-atrum*) causing e.g. *verticillium* wilt; in another specific embodiment the plant is potato and the fungus is *Rhizoctonia* spp. (e.g. *Rhizoctonia solani, Rhizoctonia oryzae* or *Rhizoctonia cerealis*) causing e.g. early blight. In another specific embodiment the plant is potato and the fungus is a fungal species causing e.g. wilts, rots or scurf; in another specific embodiment the plant is tomato and the fungus is a fungal species causing e.g. foliar disease, wilts or fruit rots.

In another embodiment the present invention extends to methods as described herein, wherein the plant is rice and wherein said target gene is a gene coding for a fungal orthologue of a protein selected from the group of proteins whose function is given in Table 1.

Transgenic plants according to the invention extend to all plant species specifically described above being resistant to the respective fungus species as specifically described above. Preferred transgenic plants (or reproductive or propagation material for a transgenic plant, or a cultured transgenic plant cell) are plants (or reproductive or propagation material for a transgenic plant, or a cultured transgenic plant cell) wherein said fungal target gene comprises a sequence which is selected from the group comprising:

(i) sequences which are at least 75%, preferably at least 80% or 85% identical, preferably at least 90%, 95%, 96%, or more preferably at least 97%, 98% and still more preferably at least 99% identical to a sequence represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof, and (ii) sequences comprising at least 17, preferably at least 18, 19, 20 or 21, more preferably at least 22, 23 or 24 contiguous nucleotides of any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof, or wherein said fungal target gene is a fungal orthologue of a gene comprising at least 17 contiguous nucleotides of any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof.

Transgenic plants according to the invention extend to all plant species specifically described above being resistant to the respective fungal species as specifically described above.

In one embodiment the transgenic plant (or reproductive or propagation material for a transgenic plant or a cultured transgenic plant cell) is a rice plant or reproductive or propagation material for a rice plant or a cultured rice plant cell, wherein the target gene is a gene from a fungus selected from the group comprising *Magnaporthe* spp., *Rhizoctonia* spp., *Fusarium* spp., *Acremoniella* spp., *Pythium* spp., *Curvularia* spp., *Trichoderma* spp. and *Rhizopus* spp.

In yet another embodiment the transgenic plant (or reproductive or propagation material for a transgenic plant or a cultured transgenic plant cell) is a rice, cotton, potato, tomato, corn, tobacco, banana or soybean plant or reproductive or propagation material of such a plant and wherein the target gene is coding for a fungal orthologue of a protein selected from the group of proteins whose function is given in Table 1.

The present invention also encompasses transgenic plants (or reproductive or propagation material for a transgenic plant, or a cultured transgenic plant cell) which express or are capable of expressing at least one of the nucleotides of the invention, for instance at least one of the nucleotide sequences represented in any of SEQ ID Nos 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859 or the complement thereof, or comprising a fragment thereof comprising at least 17, preferably at least 18, 19, 20 or 21, more preferably at least 22, 23 or 24 nucleotides.

The plant may be provided in a form wherein it is actively expressing (transcribing) the double-stranded RNA in one or more cells, cell types or tissues. Alternatively, the plant may be "capable of expressing", meaning that it is transformed with a transgene which encodes the desired dsRNA but that the transgene is not active in the plant when (and in the form in which) the plant is supplied.

Therefore, according to another embodiment, a recombinant DNA construct is provided comprising the nucleotide sequence encoding the dsRNA or dsRNA construct according to the present invention operably linked to at least one regulatory sequence. Preferably, the regulatory sequence is selected from the group comprising constitutive promoters or tissue specific promoters as described in the invention.

The target gene may be any target gene herein described. Preferably the regulatory element is a regulatory element that is active in a plant cell. More preferably, the regulatory element is originating from a plant. The term "regulatory sequence" is to be taken in a broad context and refer to a regulatory nucleic acid capable of effecting expression of the sequences to which it is operably linked.

Encompassed by the aforementioned term are promoters and nucleic acids or synthetic fusion molecules or derivatives thereof which activate or enhance expression of a nucleic acid, so called activators or enhancers. The term "operably linked" as used herein refers to a functional linkage between the promoter sequence and the gene of interest, such that the promoter sequence is able to initiate transcription of the gene of interest.

By way of example, the transgene nucleotide sequence encoding the double-stranded RNA could be placed under the control of an inducible or growth or developmental stage-specific promoter which permits transcription of the dsRNA to be turned on, by the addition of the inducer for an inducible promoter or when the particular stage of growth or development is reached.

Alternatively, the transgene encoding the double-stranded RNA is placed under the control of a strong constitutive promoter such as any selected from the group comprising the CaMV35S promoter, doubled CaMV35S promoter, ubiquitin promoter, actin promoter, rubisco promoter, GOS2 promoter, Figwort mosaic viruse (FMV) 34S promoter.

Alternatively, the transgene encoding the double-stranded RNA is placed under the control of a tissue specific promoter such as any selected from the group comprising root specific promoters of genes encoding PsMTA Class III Chitinase, photosynthetic tissue-specific promoters such as promoters of cab1 and cab2, rbcS, gapA, gapB and ST-LS1 proteins, JAS promoters, chalcone synthase promoter and promoter of RJ39 from strawberry.

Furthermore, when using the methods of the present invention for developing transgenic plants resistant against fungi, it might be beneficial to place the nucleic acid encoding the double-stranded RNA according to the present invention under the control of a tissue-specific promoter. In order to improve the transfer of the dsRNA from the plant cell to the pest, the plants could preferably express the dsRNA in a plant part that is first accessed or damaged by the plant pest. In case of a plant pathogenic fungi, preferred tissues to express the dsRNA are the roots, leaves and stem. Therefore, in the methods of the present invention, a plant tissue-preferred promoter may be used, such as a root specific promoter, a leaf specific promoter or a stem-specific promoter. Suitable examples of a root specific promoter are PsMTA (Fordam-Skelton, A. P., et al., 1997 Plant Molecular Biology 34: 659-668.) and the Class III Chitinase promoter. Examples of leaf- and stem-specific or photosynthetic tissue-specific promoters that are also photo-activated are promoters of two chlorophyll binding proteins (cab1 and cab2) from sugar beet (Stahl D. J., et al., 2004 BMC Biotechnology 2004 4:31), ribulose-bisphosphate carboxylase (Rubisco), encoded by rbcS (Nomura M. et al., 2000 Plant Mol. Biol. 44: 99-106), A (gapA) and B (gapB) subunits of chloroplast glyceraldehyde-3-phosphate dehydrogenase (Conley T. R. et al. 1994 Mol. Cell Biol. 19: 2525-33; Kwon H. B. et al. 1994 Plant Physiol. 105: 357-67), promoter of the *Solanum tuberosum* gene encoding the leaf and stem specific (ST-LS1) protein (Zaidi M. A. et al., 2005 Transgenic Res. 14:289-98), stem-regulated, defense-inducible genes, such as JAS promoters (patent publication no. 20050034192/US-A1), flower-specific promoters such as chalcone synthase promoter (Faktor O. et al. 1996 Plant Mol. Biol. 32: 849) and fruit-specific promoters such as that of RJ39 from strawberry (WO 98 31812).

In yet other embodiments of the present invention, other promoters useful for the expression of dsRNA are used and include, but are not limited to, promoters from an RNA PoII, an RNA PoIII, an RNA PoIIII, T7 RNA polymerase or SP6 RNA polymerase. These promoters are typically used for in vitro-production of dsRNA, which dsRNA is then included in an antifungal agent, for example in an anti-fungal liquid, spray or powder.

Therefore, the present invention also encompasses a method for generating any of the double-stranded RNA or RNA constructs of the invention. This method comprises the steps of (a) contacting an isolated nucleic acid or a recombinant DNA construct of the invention with cell-free components; or (b) introducing (e.g. by transformation, transfection or injection) an isolated nucleic acid or a recombinant DNA construct of the invention in a cell, under conditions that allow transcription of said nucleic acid or recombinant DNA construct to produce the dsRNA or RNA construct.

In one embodiment of the present invention, there is provided a recombinant DNA construct as described herein for use as a medicament.

Accordingly, the present invention also encompasses a cell comprising any of the nucleotide sequences or recombinant DNA constructs described herein. The invention further encompasses prokaryotic cells (such as, but not limited to, gram-positive and gram-negative bacterial cells) and eukaryotic cells (such as, but not limited to, yeast cells or plant cells). Preferably said cell is a bacterial cell or a plant cell.

Optionally, one or more transcription termination sequences may also be incorporated in the recombinant construct of the invention. The term "transcription termination sequence" encompasses a control sequence at the end of a transcriptional unit, which signals 3' processing and polyadenylation of a primary transcript and termination of transcription. Additional regulatory elements, such as transcriptional or translational enhancers, may be incorporated in the expression construct.

The recombinant constructs of the invention may further include an origin of replication which is required for maintenance and/or replication in a specific cell type. One example is when an expression construct is required to be maintained in a bacterial cell as an episomal genetic element (e.g. plasmid or cosmid molecule) in a cell. Preferred origins of replication include, but are not limited to, f1-ori and colE1 ori.

The recombinant construct may optionally comprise a selectable marker gene. As used herein, the term "selectable marker gene" includes any gene, which confers a phenotype on a cell in which it is expressed to facilitate the identification and/or selection of cells, which are transfected or transformed, with an expression construct of the invention. Examples of suitable selectable markers include resistance genes against ampicillin (Ampr), tetracycline (Tcr), kanamycin (Kanr), phosphinothricin, and chloramphenicol (CAT) gene. Other suitable marker genes provide a metabolic trait, for example manA. Visual marker genes may also be used and include for example beta-glucuronidase (GUS), luciferase and Green Fluorescent Protein (GFP).

Plants that have been stably transformed with a transgene encoding the dsRNA may be supplied as seed, reproductive material, propagation material or cell culture material which does not actively express the dsRNA but has the capability to do so.

Accordingly, the present invention encompasses a plant (e.g. a rice plant), or a seed (e.g. a rice seed), or a cell (e.g. a bacterial or plant cell), comprising any of the nucleotide sequences encoding the dsRNA or dsRNA construct as described herein. The present invention also encompasses a plant (e.g. a rice, barley, rye, wheat, miller, lovegrass or crabgrass plant), or a seed (e.g. a rice, barley, rye, wheat, miller, lovegrass or crabgrass seed), or a cell (e.g. a bacterial or plant cell), comprising any of the dsRNA or dsRNA constructs described herein. Preferably, these plants or seeds or cells comprise a recombinant construct wherein the nucleotide sequence encoding the dsRNA or dsRNA construct according to the present invention is operably linked to at least one regulatory element as described above. Preferably the plant or seed or cell is rice, or a rice seed or a rice cell.

General techniques for expression of exogenous double-stranded RNA in plants for the purposes of RNAi are known in the art (see Baulcombe D, 2004, Nature. 431(7006):356-63. RNA silencing in plants, the contents of which are incorporated herein by reference). More particularly, methods for expression of double-stranded RNA in plants for the purposes of down-regulating gene expression in plant pests such as nematodes or insects are also known in the art. Similar methods can be applied in an analogous manner in order to express double-stranded RNA in plants for the purposes of down-regulating expression of a target gene in a plant pathogenic fungus. In order to achieve this effect it is necessary only for the plant to express (transcribe) the double-stranded RNA in a part of the plant which will come into direct contact with the fungus, such that the double-stranded RNA can be taken up by the fungus. Depending on the nature of the fungus and its relationship with the host plant, expression of the dsRNA could occur within a cell or tissue of a plant within which the fungus is also present during its life cycle, or the RNA may be secreted into a space between cells, such as the apoplast, that is occupied by the fungus during its life cycle. Furthermore, the dsRNA may be located in the plant cell, for example in the cytosol, or in the plant cell organelles such as a chloroplast, mitochondrion, vacuole or endoplastic reticulum.

Alternatively, the dsRNA may be secreted by the plant cell and by the plant to the exterior of the plant. As such, the dsRNA may form a protective layer on the surface of the plant.

In a further embodiment, the invention relates to a composition for controlling fungal growth and/or preventing or reducing fungal infestation, comprising at least one double-stranded RNA, wherein the double-stranded RNA comprises annealed complementary strands, one of which has a nucleotide sequence which is complementary to at least part of a nucleotide sequence of a fungal target gene and optionally further comprising at least one suitable carrier, excipient or diluent. The target gene may be any target gene described herein. Preferably the fungal target gene is essential for the viability, growth, development or reproduction of the fungus, for instance the fungal target gene is involved in any of the cellular functions as presented in Table 1; or the fungal target gene is involved in the pathogenicity or infectivity of the fungus, for instance the fungal target gene is involved in the formation of germ tubes, conidia attachment, formation of appressoria, formation of the penetration peg or formation of conidia.

In another aspect the invention relates to a composition as described above, wherein the fungal target gene comprises a sequence which is at least 75%, preferably at least 80%, 85%, 90%, more preferably at least 95%, 98% or 99% identical to a sequence selected from the group of sequences represented by any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859, or the complement thereof, or wherein said fungal target gene is a fungal orthologue of a gene comprising any of SEQ ID NOs 3, 42, 99, 100, 527, 39, 60, 111, 112, 113, 114, 115, 116, 117, 536, 537, 538, 5, 43, 101, 102, 528, 1, 41, 97, 98, 526, 184, 185, 37, 59, 124, 9, 45, 106, 531, 188, 189, 13, 47, 109, 534, 33, 57, 126, 23, 52, 119, 35, 58, 127, 7, 44, 103, 104, 105, 529, 186, 187, 29, 55, 118, 17, 49, 108, 533, 25, 53, 121, 19, 50, 125, 31, 56, 123, 11, 46, 107, 532, 27, 54, 122, 21, 51, 120, 15, 48, 110, 535, 458, 486, 530, 460, 487, 539, 540, 462, 488, 541, 464, 489, 542, 466, 490, 543, 468, 491, 544, 470, 492, 545, 472, 493, 546, 474, 494, 547, 476, 496, 548, 478, 556, 549, 480, 497, 550, 482, 498, 551, 484, 499, 552 and 562 to 859.

The present invention further relates to a composition comprising at least one double-stranded RNA, at least one double-stranded RNA construct, at least one nucleotide sequence and/or at least one recombinant DNA construct as descried herein, optionally further comprising at least one suitable carrier, excipient or diluent.

The composition may contain further components which serve to stabilise the dsRNA and/or prevent degradation of the dsRNA during prolonged storage of the composition.

The composition may still further contain components which enhance or promote uptake of the dsRNA by the fungal cell. These may include, for example, chemical agents which generally promote the uptake of RNA into cells e.g. lipofectamin etc., and enzymes or chemical agents capable of digesting the fungal cell wall, e.g. a chitinase.

The composition may be in any suitable physical form for application to fungal cells, to substrates, to cells (e.g. plant cells), or to organism infected by or susceptible to infection by fungi.

It is contemplated that the "composition" of the invention may be supplied as a "kit-of-parts" comprising the double-stranded RNA in one container and a suitable diluent or carrier for the RNA in a separate container. The invention also relates to supply of the double-stranded RNA alone without any further components. In these embodiments the dsRNA may be supplied in a concentrated form, such as a concentrated aqueous solution. It may even be supplied in frozen form or in freeze-dried or lyophilised form. The latter may be more stable for long term storage and may be de-frosted and/or reconstituted with a suitable diluent immediately prior to use.

The present invention further relates to the medical use of any of the double-stranded RNAs, double-stranded RNA constructs, nucleotide sequences, recombinant DNA constructs, hairpin sequences or compositions described herein.

In one specific embodiment, the composition is a pharmaceutical or veterinary composition for treating or preventing fungal disease or infections of humans or animals, respectively. Such compositions will comprise at least one double-stranded RNA or RNA construct, or nucleotide sequence or recombinant DNA construct encoding the double-stranded RNA or RNA construct, wherein the double-stranded RNA comprises annealed complementary strands, one of which has a nucleotide sequence which corresponds to a target nucleotide sequence of a fungal target gene that causes the disease or infection, and at least one carrier, excipient or diluent suitable for pharmaceutical use.

The composition may be a composition suitable for topical use, such as application on the skin of an animal or human, for example as liquid composition to be applied to the skin as drops, gel, aerosol, or by brushing, or a spray, cream, ointment, etc. for topical application or as transdermal patches.

Alternatively, the fungal dsRNA is produced by bacteria (e.g. lactobacillus) which can be included in food and which functions as an oral vaccine against the fungal infection.

Other conventional pharmaceutical dosage forms may also be produced, including tablets, capsules, pessaries, transdermal patches, suppositories, etc. The chosen form will depend upon the nature of the target fungus and hence the nature of the disease it is desired to treat.

Preferred target human pathogenic and animal pathogenic fungi include, but are not limited to the following:

In humans: *Candida* spp., particularly *Candida albicans*; Dermatophytes including *Epidermophyton* spp., *Trichophyton* spp, and *Microsporum* spp.; *Aspergillus* spp., particularly *Aspergillus flavus, Aspergillus fumigatus, Aspergillus nidulans, Aspergillus niger* or *Aspergillus* terreus group; *Blastomyces dermatitidis; Paracoccidioides brasiliensis; Coccidioides immitis; Cryptococcus neoformans; Histoplasma capsulatum* Var. *capsulatum* or Var. *duboisii; Sporothrix schenckii; Fusarium* spp.; *Scopulariopsis brevicaulis* and *Fonsecaea* spp.; *Penicillium*; Zygomycetes group of fungi, particularly *Absidia corymbifera, Rhizomucor pusillus*, and *Rhizopus arrhizus;*

In animals: *Candida* spp.; *Microsporum* spp., particularly *Microsporum canis, Microsporum gypseum; Trichophyton mentagrophytes; Aspergillus* spp.; or *Cryptococcus neoformans.*

In one specific embodiment, the composition may be a coating that can be applied to a substrate in order to protect the substrate from infestation by a fungus and/or to prevent, arrest or reduce fungal growth on the substrate and thereby prevent damage caused by the fungus. In this embodiment, the composition can be used to protect any substrate or material that is susceptible to infestation by or damage caused by a fungus, for example foodstuffs and other perishable materials, and substrates such as wood. Preferred target fungal species for this embodiment include, but are not limited to, the following: *Stachybotrys* spp., *Aspergillus* spp., *Alternaria* spp. or *Cladosporium* spp.

The nature of the excipients and the physical form of the composition may vary depending upon the nature of the substrate that is desired to treat. For example, the composition may be a liquid that is brushed or sprayed onto or imprinted into the material or substrate to be treated, or a coating that is applied to the material or substrate to be treated.

The present invention further encompasses a method for treating and/or preventing fungal infestation on a substrate comprising applying an effective amount of any of the compositions described herein to said substrate.

The invention further encompasses a method for treating and/or preventing a fungal disease or condition, comprising administering to a subject in need of such treatment and/or prevention, any of the compositions as herein described, said composition comprising at least one double-stranded RNA or double-stranded RNA construct comprising annealed complementary strands, one of which has a nucleotide sequence which is complementary to at least part of a nucleotide sequence of a fungal target gene that causes the fungal disease or condition.

In another embodiment of the invention the compositions are used as a fungicide for a plant or for propagation or reproductive material of a plant, such as on seeds. As an example, the composition can be used as a fungicide by spraying or applying it on plant tissue or spraying or mixing it on the soil before or after emergence of the plantlets.

In yet another embodiment, the present invention provides a method for treating and/or preventing fungal growth and/or fungal infestation of a plant or propagation or reproductive material of a plant, comprising applying an effective amount of any of the compositions herein described to a plant or to propagation or reproductive material of a plant.

In another embodiment the invention relates to the use of transiently inserting dsRNA or RNA constructs, or a nucleotide sequence or recombinant DNA constructs encoding the double-stranded RNA or RNA construct described herein, in plants to treat fungi infested plants or plant fields. The transient transformation can for instance, but not necessarily, be established by modified plant virusses containing the appropriate nucleotide sequences to express fungus derived dsRNA in plants.

In another embodiment the invention relates to the use of any double-stranded RNA or RNA construct, or nucleotide sequence or recombinant DNA construct encoding the double-stranded RNA or RNA construct described herein, or to any of the compositions comprising the same, used for controlling fungal growth; for preventing fungal infestation of plants susceptible to fungal infection; or for treating fungal infection of plants. Specific plants to be treated for fungal infections caused by specific fungal species are as described earlier and are encompassed by the said use.

The invention further relates to a kit comprising at least one double-stranded RNA, or double-stranded RNA construct, or nucleotide sequence, or recombinant DNA construct, or cell, or composition as described earlier for treating fungal infection in plants. The kit may be supplied with suitable instructions for use. The instructions may be printed on suitable packaging in which the other components are supplied or may be provided as a separate entity, which may be in the form of a sheet or leaflet for example. The instructions may be rolled or folded for example when in a stored state and may then be unrolled and unfolded to direct use of the remaining components of the kit.

According to a still further embodiment, the present invention extends to a method for increasing plant yield comprising introducing in a plant any of the nucleotide sequences or recombinant DNA constructs as herein described in an expressible format. Plants encompassed by this method are as described earlier. Preferably, said plant is rice.

In one specific embodiment, the method of the invention may also be used as a tool for experimental research, particularly in the field of functional genomics. Targeted down-regulation of fungal genes by RNAi can be used in in vitro or in vivo assays in order to study gene function, in an analogous approach to that which has been described in the art for the nematode worm *C. elegans* and also *Drosophila melanogaster*. Assays based on targeted down-regulation of specific fungal genes, leading to a measurable phenotype may also form the basis of compound screens for novel anti-fungal agents.

DESCRIPTION OF FIGURES AND TABLES

FIG. 1: Effect of dsRNA on the mycelium growth of the *Magnaporthe grisea*. Data are shown for the dsRNA of the beta-tubulin target gene (MG00604.4 (nt 1151-1344, see table 3A) (a), MG00884.4 (nt 845-1044, see table 3A) (b), MG07031.4 (nt 251-500, see table 3A) (c), and MG04484.4 (nt 211-409, see table 3A) (d). Each assay consists of 4 replicates, in a 96-well format and is compared to an assay with control dsRNA such as that from GST. Each dsRNA is added to 1250 fungal spores at 0.5 mg/ml, and absorbance readings are taken at 0, 24 and 30 hours after addition of dsRNA. The percent inhibition by dsRNA of beta-tubulin is significant at $P<0.05$ at 24 and 30 hours. The dotted line indicates background absorbance at O.D. 595 nm.

Figure 2:
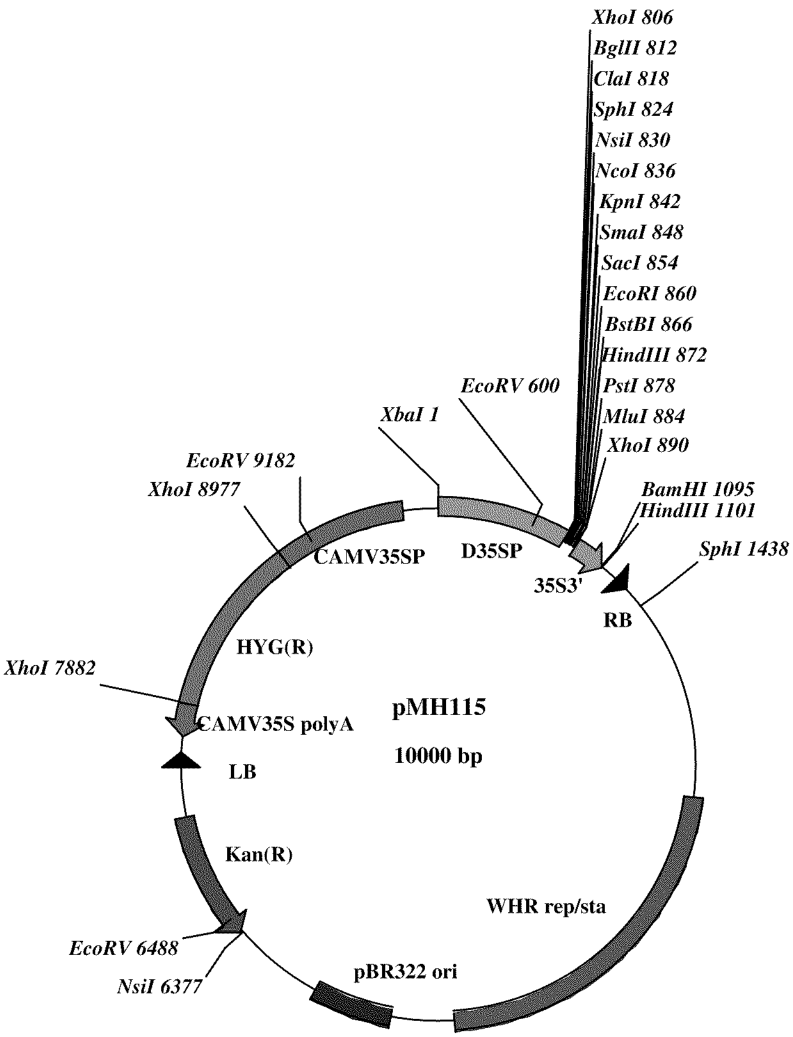

FIG. 2: Plasmid map of the plant expression vector pMH115.

FIGS. 3A-3MM: List of target genes including the coding sequences. The start and stop codons are at the beginning and at the end of the underlined sequence.

FIGS. 4A-4D: List of hairpin sequences. The sequence in bold represents the SI intron (SEQ ID NO 204).

Figure 5:
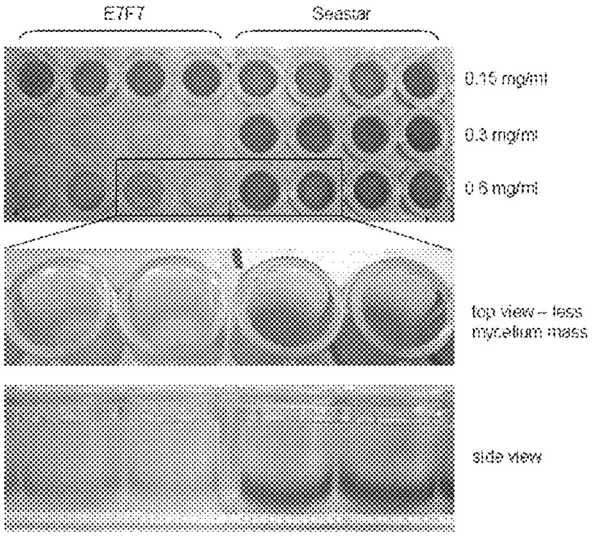

FIG. 5: *Magnaporthe grisea* strain R67 in the color assay with beta-tubulin dsRNA E7F7 and Seastar dsRNA. Top and side views of four of the wells show the thicker mycelium corresponding in the Seastar dsRNA wells to the darker appearance of the wells.

Figure 6:
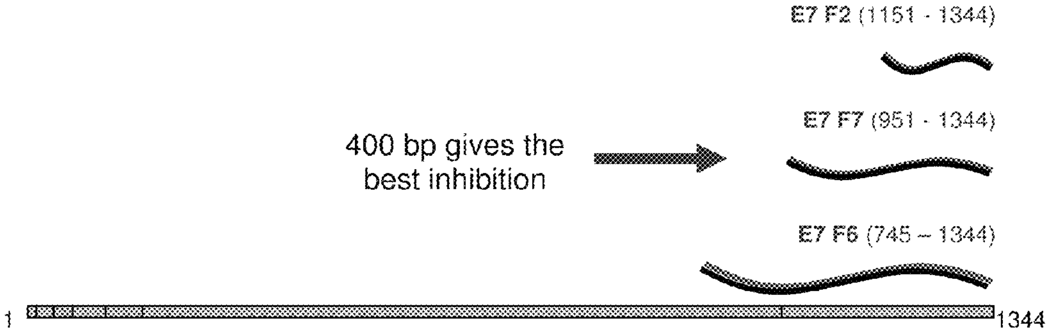

FIG. 6: Beta-tubulin fragments tested. Three dsRNA fragments of about 200, 400 and 600 bp (SEQ ID Nos 536, 537 and 538) of the regions indicated were tested in the color assay to determine what size gives the best RNAi effect.

Figure 7:
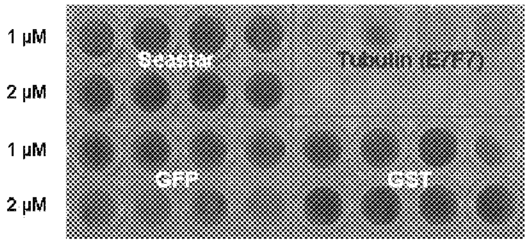

FIG. 7: Color assay of negative controls Seastar AFP, GFP and GST compared to tubulin fragment E7F7 (SEQ ID No 537).

FIG. 8: Color assay of some target genes tested. (A) Spores were incubated with various concentrations of dsRNA of targets 1 (MG00170.4), 5 (MG09222.4), 14 (MG02952.4) and 19 (MG05193.4); (B) summarizes results of color assay: "+" indicates the appearance of a light color, "×" indicates a medium color and "−" a dark color for each well of a 4 replica experiment per target, in 0.5, 1, 2 and 4 μM dsRNA used in the treatment.

Figure 9:
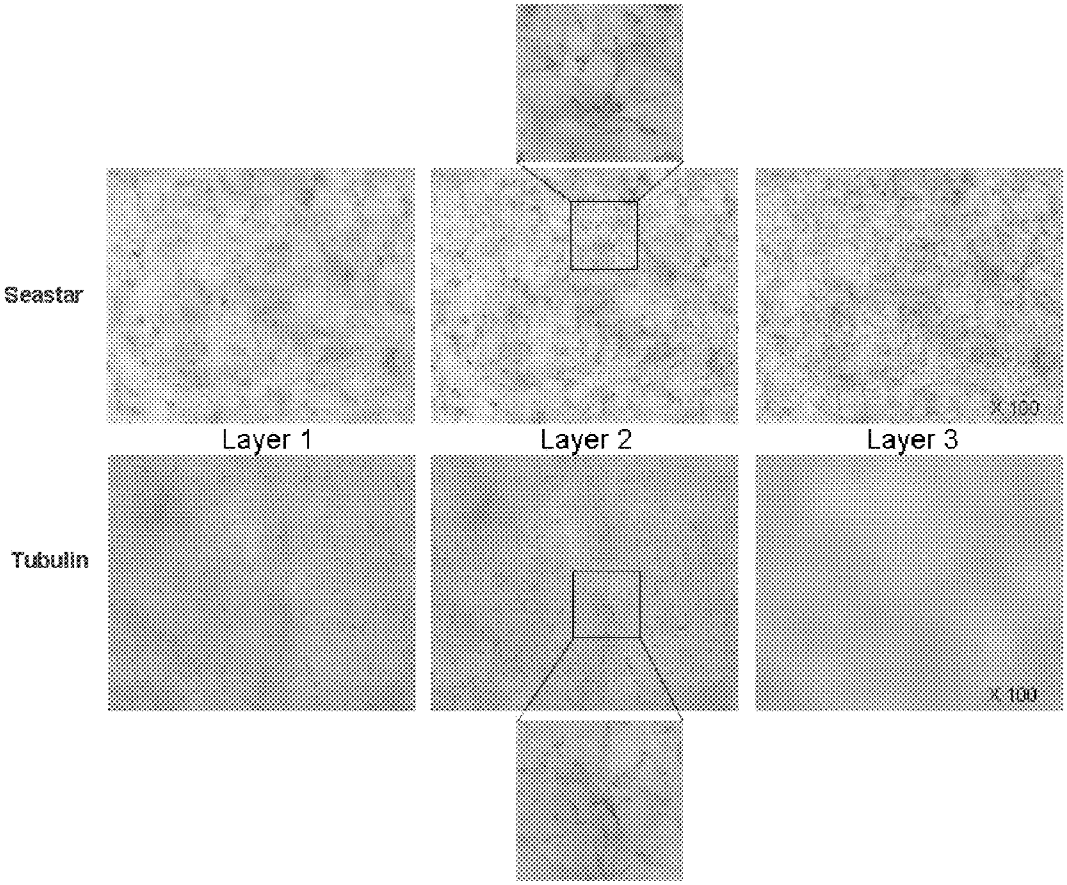

FIG. 9: Sporulation assay of β-tubulin. Wells of 48-well plates were filled with spores and dsRNA and the plate grown at 26° C. in continuous light for 4-5 days to induce spore formation. The spores were viewed under a Nikon microscope and the pictures taken with a 4× objective at 3 levels of focus (layers 1, 2, 3). Boxed areas are enlarged to show spores in the Seastar dsRNA-treated mycelium (upper panels) and lack of spores in the β-tubulin dsRNA (E7F7)-treated mycelium (lower panels) (SEQ ID No 537).

Table 1: Examples of suitable fungal target genes. The DNA and protein sequences given in the table originate from the rice blast fungus *Magnaporthe grisea* (also known as *Magnaporthe oryzae*). Identifiers correspond to the gene identifiers of the *M. grisea* genome project. The homologous genes of the budding yeast *Saccharomyces cerevisiae* are also given, identifiers correspond to gene identifiers of the Saccharomyces Genome Database (SGD™), together with gene function assigned on the basis of yeast data.

Table 2: Examples of suitable fungal target genes. The DNA and protein sequences given in the table correspond with fungal orthologues of the rice blast fungus *Magnaporthe grisea* genes of Table 1. Identifiers correspond to accession number and version number.

Table 3: Overview of cloning details of (A) cDNA's of *Magnaporthe grisea* target genes and (B) fragments. PCR conditions were as follows: A: Expand High Fidelity PCR system (Roche) 5' 94° C., 30 cycles (1' 94° C., 1' 58° C., 1' 72° C.) 10' 72° C.; B: Expand High Fidelity PCR system (Roche) 5' 94° C., 30 cycles (45" 94° C., 45" 58° C., 45" 72° C.), 10' 72° C.; C: Expand High Fidelity PCR system (Roche) 5' 94° C., 30 cycles (45" 94° C., 45" 58° C., 45" 72° C.), 10' 72° C.; D: Expand High Fidelity PCR system (Roche) 5' 94° C. 30 cycles (1' 94° C., 1' 60° C., 3' 72° C.), 5' 72° C.; E: Taq Polymerase (Bangalore Genei) 3' 95° C., 10 cycles (30" 95° C., 30" 55° C., 3' 72), 25 cycles (30" 95° C., 30" 55° C., 3'(+5"/cycle) 72), 7' 72° C.; and F: GC Polymerase (BD Biosciences) 5' 94° C., 30 cycles (1' 94° C., 1' 58° C., 3' 68° C.) 10' 68° C.; G: RedTaq polymerase (Sigma) 2' 94° C., 33 cycles (2' 94° C., 30" 56° C., 30" 72° C.) 10' 72° C.

Table 4: Overview of cloning details of exons of *Magnaporthe grisea* target genes using gDNA as template. PCR conditions were as follows: A: Pwo polymerase (Roche) 5' 94° C., 30 cycles (30" 94° C., 30" 60° C., 1' 72° C.) 5' 72° C.; B: Pwo polymerase (Roche) 5' 94° C., 30 cycles (30" 94° C., 30" 58° C., 30" 72° C.) 5' 72° C.; C: Pwo polymerase (Roche) 5' 94° C., 30 cycles (1' 94° C., 1' 61° C., 1'30" 72° C.) 5' 72° C.; D: Pwo polymerase (Roche) 5' 94° C., 30 cycles (30" 94° C., 30" 60° C., 30" 72° C.) 5' 72° C.; E: Pwo polymerase (Roche) 5' 94° C., 30 cycles (45" 94° C., 45" 60° C., 45" 72° C.) 5' 72° C.; F: Pwo polymerase (Roche) 10' 94° C., 30 cycles (1' 94° C., 1' 60° C., 3' 72° C.) 10' 72° C.

Table 5A and 5B: Selected target nucleotide sequences of the fungal target genes: (IV) stands for experiments in vitro done, (PE) for plant expression experiments and * are ongoing experiments in vitro.

Table 6: Primers used for hairpin construction in pMH115

Table 7: Sporulation phenotype in the presence of 1 or 2 μM dsRNA of targets and negative controls (Seastar and GST) at 4 days. "−" indicates a >90% reduction, "+/−" indicates a 80-90% reduction, "+" indicates a 75-80% reduction in spore formation. "+++" indicates untreated or negative control dsRNA-treated level of spores formed.

Table 8: Selected sequences* of target genes. Fragments of at least 17 bp of the sequences* are present in any of the orthologues sequences in fungi species (represented by GI number in the right column; several database entry numbers were found but only one is given by way of example).

Table 9: Selected sequences* of target genes. Fragments of at least 17 bp of the sequences* are present in any of the orthologues sequences in nematode species (represented by GI number in the right column; several database entry numbers were found but only one is given by way of example).

Table 10: Selected sequences* of target genes. Fragments of at least 17 bp of the sequences* are present in any of the orthologues sequences in insect species (represented by GI number in the right column; several database entry numbers were found but only one is given by way of example).

The invention will be further understood with reference to the following non-limiting examples.

EXAMPLES

Example 1

Cloning of Target Genes

The methods for dsRNA mediated gene silencing in fungi as described herein are applicable to combat plant pathogenic fungi with dsRNA corresponding to a plant pathogen target gene. Suitable plant pathogen target genes were identified and isolated from the fungus as follows.

Total RNA was prepared from the fungus *Magnaporthe grisea* using the RNEASY® (RNA purification) Mini kit for plants (QIAGEN Cat. No. 74904), from which cDNA was prepared using the SUPERSCRIPT® (reverse transcriptase) Double-Stranded cDNA synthesis kit (Invitrogen). To isolate the coding sequence of the *Magnaporthe grisea* target genes MG00884.4, MG04484.4, MG07472.4, MG06292.4, MG03668.4, MG05169.4 and MG03872.4, PCRs were performed on the *Magnaporthe grisea* cDNA or on genomic DNA as a template.

The PCR conditions and primers for the target gene are outlined in the tables. Each PCR was performed in duplicate. The resulting two independent PCR products per target gene, were analysed on agarose gel, isolated and cloned into the pTZ57R/T vector (MBI Fermentas). For each PCR product, at least three clones were sequenced. The sequences resulting from the clones were compared to the public database sequences and one or more clones per target gene were selected for further experimentation. Cloning details of the coding sequences of these genes are herein represented in the tables.

To isolate fragments of the *Magnaporthe grisea* target genes, total RNA was extracted from *Magnaporthe grisea* mycelium (RNEASY® (RNA purification) Plant Mini kit, Qiagen). A reverse transcription reaction (SUPERSCRIPT® II (reverse transcriptase), Invitrogen) was done on the total RNA to produce the first strand cDNA, which was then used to amplify partial or full cDNA of target fragments. The cDNA's were cloned into a TOPO® (topoisomerase) TA vector (Invitrogen), and the constructs were used as templates to synthesize dsRNA from (T7 RIBOMAX™ kit (in vitro transcription system), Promega).

Seastar AFP (autofluorescent protein) template was an in-house clone pGR37, Glutathione S-transferase (GST) was amplified from pGEX4T-1, GFP was amplified from an in-house clone, pDW2821. Exons of beta-tubulin genes were amplified directly from gDNA and used as templates for dsRNA synthesis.

Alternative Cloning: Cloning of Exons of cDNA:

For cDNA's that could not be amplified from total RNA, exons were amplified from genomic DNA (gDNA) and the exons ligated together to form the cDNA. Genomic DNA of *Magnaporthe grisea* was prepared using a protocol modified from Naqvi et al. (Molecular Breeding, 1995, 1: 341-348). About 150 mg of dried mycelium was ground in liquid nitrogen into powder form and extracted for genomic DNA in extraction buffer (10 mM Tris pH 8.0, 1 mM EDTA, 0.25 M NaCl, 1% SDS) at 65° C. for 30'. Cell debris and proteins were precipitated by adding potassium acetate 5 M pH 4.8 at −20° C. freezer for 15'. The pellet was removed by centrifugation at 14000 rpm for 10'. The supernatant was transferred to a fresh tube and extracted with phenol/$CH_3Cl$/isoamyl alcohol mix. The aqueous layer was precipitated with isopropanol. The DNA pellet was washed with 70% ethanol, air-dried and resuspended in TE. This preparation is used as template for amplification of exons by PCR of the following fungal target genes.

To isolate the coding region of the *Magnaporthe grisea* target genes MG00170.4, MG07031.4, MG02946.4 and MG10192.4, two independent PCRs were performed for each exon of each target gene. The full length genomic gene sequence amplified from gDNA was used as template for amplifying each of the exons to compile the cDNA comprising the coding region. The PCR conditions for each exon of the target genes are outlined in Table 4. Subsequently, to obtain the full length coding sequence, the amplified exons/PCR products originating from the same target were analyzed on agarose gel, isolated, and ligated to each other in the correct order. This ligation was achieved as follows:

Step 1: PCR amplification of each exon using the proof reading enzyme Pwo polymerase (Roche), producing blunt ends.

Step 2: Phosphorylation of 2.5 pmols of the second exon using 1 unit of Polynucleotide kinase (PNK, Bangalore Genei) in a 15 μl reaction with 1 mM ATP.

Step 3: Blunt end ligation of the two exons.

Step 4: PCR amplification of the full-length gene from the ligation mix using gene specific forward and reverse primers. This step ensures selection of only those ligation products in which the exons are ligated in the correct order.

In case of target gene MG07031.4 (3), which has 5 exons, the first two exons (Exon 1 and 2 which were 70 bp and 21 bp respectively) were synthetically made. The last 3 exons were amplified as outlined hereinabove and ligated as follows:

1—Ligation and PCR amplification of Exon 4+5 to obtain Exon 4,5

2—Ligation and PCR amplification of Exon 3+ Exon 4, 5 to obtain Exon 3, 4, 5

3—Ligation of synthetic Exon 1+2 to Exon 3, 4, 5 followed by amplification to obtain Exon 1, 2, 3, 4, 5 (Spliced gene).

The ligation products were cloned into the pTZ57R/T vector (MBI Fermentas). For each ligation product, at least 3 clones were sequenced. The sequences resulting from the clones were compared to the public database sequences and one or more clones per target gene were selected for further experimentation. Cloning details of exons which are joined to form the coding sequences of these target gens are herein represented in Table 4. cDNA's of the other target genes were cloned by one of the above approaches.

Example 2

Optimization of Fragment Length

The beta-tubulin was used to optimize the size of fragments that give color effect in the color assay (Example 4.3). 200, 400 and 600 bp fragments from the 3' end of the coding region were tested in the color assay and a 400 bp, E7F7 (FIG. 6), was found to be optimal for causing a lighter color. Subsequently, for all the targets, 400 bp dsRNA was used in the color assay. Spores from two *Magnaporthe grisea* isolates, R67 (FIG. 5) and B157 (FIGS. 7 & 8) gave a similar color phenotype in this assay.

Example 3

Selection of Target Nucleotide Sequences of the Target Genes of *Magnaporthe grisea* for RNAi Mediated Gene Silencing Fragments of the target genes herein described were selected for use in further RNAi experiments both in vitro as described in example 4 or in vivo as described in examples 5, 6 and 7. These fragments are listed in Table 5. (PY may be A person skilled in the art will recognize that other fragments of various lengths may be identified in the *Magnaporthe grisea* sequences, and that the present invention also extends to these fragments and the use thereof in RNAi mediated silencing of fungal genes.

These fragments or target nucleotide sequences of fungal target genes were used to produce dsRNA in vitro as is described in example 4, or were cloned in a hairpin construct to produce dsRNA in a plant cell (see example 5).

Example 4

The Effect of Silencing a Target Gene in *Magnaporthe grisea* In Vitro

In Vitro Assays

Germinating conidia have been shown to actively take up materials from the medium by endocytosis. In the following assay germinating conidia of *Magnaporthe grisea* were used to demonstrate uptake of dsRNA by fungi in vitro. Conidia were germinated in hydrophilic conditions, mimicking their germination within the leaf after penetration of the fungus. On a hydrophilic surface, the conidia grow vegetatively into mycelia.

dsRNA corresponding to target regions of target genes were prepared from genomic DNA or cDNA as follows. Two PCR reactions were set up: one to amplify the sense RNA strand, another for the antisense RNA strand. The forward primers of each reaction contain a T7 promoter sequence followed by sequences corresponding to the targeted sequence, while the reverse primer only contains sequence complementary to the target sequence. The PCR products were purified using the QIAQUICK® PCR Purification Kit (for DNA purification) (Qiagen), and subsequently used as template for in vitro transcription to produce double-stranded RNA (T7 RIBOMAX™ Express RNAi System (in vitro transcription system) Promega). The dsRNA was precipitated, quantitated and dissolved in RNase-free water.

4.1. Appressorium Assay on Hydrophobic Surface:

Conidia (asexual spores) were generated by exposing fungal mycelia to light for 7-10 days. Freshly harvested, hydrated conidia were re-suspended in water at a density of $10^4$ conidia/ml, and inoculated on the hydrophobic surface of an artificial membrane (GELBOND® film (plastic film adapted to support a gel coating), Cambrex). DsRNA corresponding to the respective fungal target genes (see Table 5) were tested individually at concentrations ranging from 0.1-1 mg/ml in a final volume of 20 μl in water. As a negative control, dsRNA corresponding to part of a GST was used. After 16-24 h incubation at 28° C., the germinated spores were stained with Acid Fuchsin for clearer visualization of cellular structures.

Formation of appressoria on the artificial membrane was observed under a microscope. The inhibition of germ tube and appressorium formation was a direct indication of inhibition of target gene expression by RNAi due to uptake of dsRNA by the intact fungus. Soaking experiments were performed in triplicate. The percentage of appressoria formed was calculated by the number of appressoria divided by the number of spores in 3 given fields in the microscope and at least 200 spores were counted per replicate.

4.2. Mycelial Growth Assay on Hydrophilic Surface

Conidia of *Magnaporthe grisea* were harvested, re-suspended in potato dextrose broth and 1250 conidia (in about 90 μl) were aliquoted in each well of a hydrophilic 96-well plates (Falcon 3072). After 0-2 h pregermination at 28° C., dsRNA was added to a final volume of 100 μl and to a final concentration of 0.1 or 0.5 mg/ml. dsRNA fragments of about 200 bp in length corresponding to distinct target regions of the target genes were tested. As negative controls, dsRNA corresponding to a part of GST, Seastar AFP or GFP were used. After 16-24 h incubation at 28° C., the growth of mycelia in the wells was quantified by optical density reading of the 96-well plates at wavelength 595 nm, in a plate reader (GENios Tecan, Austria). The fungus showed growth inhibition in the presence of target dsRNA fragments compared to controls (see Table 5 and FIG. 1). The growth inhibition phenotype was a direct indication of inhibition of target gene expression by RNAi due to uptake of dsRNA by the intact fungus. Soaking experiments were performed in quadruplicate and percentage inhibition was calculated with reference to control-soaked samples. At least two other negative controls were included in each assay to ensure consistency of inhibition results. Statistical analyses were performed using Analyse-it software.

4.3. Color Assay

Unless otherwise stated, spores from B157, an Indian isolate of *Magnaporthe grisea* strain (Naqvi N, personal communication) were used. Spores were generated after exposing mycelium to light for 9-11 days, were harvested and used fresh or frozen. Fresh and frozen spores behaved similarly in this assay (data not shown). For consistency, a single frozen stock was used in all assays reported here. The spores were diluted in PDBM (potato dextrose buffer with 25 mM MES buffer pH 5.5) before aliquoting into the wells of a 96-well plate to give 1250 spores per well.

Various amounts of dsRNA were added to spores in the wells and mixed well. The final volume was made up to 100 µl with PBDM. The plates were incubated at 28° C. in the dark and the color was recorded with a digital camera at 7 days. Spores from two *Magnaporthe grisea* isolates, R67 (FIG. 5) and B157 (FIGS. 6 & 7) gave a similar color phenotype in this assay.

4.4. Sporulation Assay

As a separate readout of RNAi effect of contacting dsRNA to spores, the sporulation phenotype was observed. In a similar assay set up as described above, the spores were incubated with dsRNA in 96 or 48 well plates. In contrast to the assay above, the plates were exposed to continuous light to induce spore formation and the plates were incubated at 26° C. At day 4-6, the extent of spore formation is viewed under a Nikon microscope and pictures taken with a Nikon digital camera (FIG. 9). Sporulation results are represented in Table 7.

Example 5

Cloning of Hairpin Constructs and Plant Expression Vectors for dsRNA Production in Plant Cells Since the mechanism of RNA interference operates through dsRNA fragments, the target nucleotide sequences of the target genes as selected above and indicated in Table 5 were cloned in anti-sense and sense orientation, separated by the 189 bp synthetic intron (SI) from the gene X from *Arabidopsis thaliana* (SI, SEQ ID NO: 204), to form a dsRNA hairpin construct. These hairpin constructs were cloned into multiple cloning sites of the plant expression vector pMH115 (SEQ ID NO: 205), comprising the double CaMV35S promoter and the CaMV35S 3' element. The cDNA clones as described above were used as templates for the PCRs. These cloning experiments resulted in a hairpin construct for each target gene, having the structure promoter-sense-SI-antisense or more preferably, promoter-antisense-SI-sense, wherein the sense fragments are given in Table 5, and wherein the promoter is any plant operable promoter, preferably a strong constitutive promoter, such as the CaMV35S promoter. The complete sequences of several hairpin constructs (antisense-SI-sense) are represented in FIGS. 4A-4D.

The hairpin constructs as described above were embedded in the binary vector pMH115 with the double CaMV35S promoter, which vector is suitable for transformation into *A. tumefaciens*, transformation into rice, and expression of the hairpin in rice.

Alternatively, other vectors are used for transformation and other promoters are used for expression of the hairpin dsRNA for the target genes herein described. For example, such promoters are selected from strong constitutive promoters including strong constitutive promoters such as CaMV35S promoter, doubled CaMV35S promoter, ubiquitin promoter, actin promoter, rubisco promoter, GOS2 promoter and FMV promoter.

The plant expression vectors comprising the *Magnaporthe grisea* hairpins were subsequently transformed into in *Agrobacterium tumefaciens* (see example 6).

Example 6

Rice Plants Resistant to *Magnaporthe grisea*

Rice calli were transformed and regenerated into shoots and whole plants as described in literature. The plants were transferred to a greenhouse and cultivated to reach maturity and to set seeds. Genomic PCR and/or Southern blotting is performed on leaf tissue of T1 plants to determine the homozygosity/heterozygosity of the integrated locus and the number of inserted copies of transgene. Transgene-positive plants are further analyzed by Northern blotting and/or RT-PCR to detect expression of dsRNA and siRNA. Homozygous lines showing expression of dsRNA and/or siRNA are established and used for fungal infection studies.

Explants (15-20 replicates each) from T1 plants (both heterozygous and homozygous integrants) are used for initial analysis of resistance to rice blast infection. The leaves of 20 day-old plants are cut and the ends of the leaves are inserted into kinetin agar plates. A small drop of *Magnaporthe grisea* spores (200-1000 spores in 20 µl water) are inoculated onto the leaves. Infection rate and lesion sizes are compared between test and negative control leaves.

In planta infection of established dsRNA-expressing strains are sprayed with fungal spores of $10^5$/ml density, and then covered with plastic bags perforated with holes. These plants are maintained in environmental chambers (Convirons) until disease symptoms develop. The timing of appearance, size and number of lesions, and the rate of plant wilting are indicators of susceptibility to *Magnaporthe grisea* infection (Valent B. 1990. Phytopathology 80: 57-67). Fifty to 100 replicates per transformed line are used in each experiment. Resistant rice strains are further tested in Convirons as well as in field conditions.

It will be appreciated by persons skilled in the art that numerous variations and/or modifications may be made to the invention as shown in the specific embodiments without departing from the spirit or scope of the invention as broadly described. The present embodiments are, therefore, to be considered in all respects as illustrative and not restrictive.

Furthermore, throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

Those skilled in the art will recognize, or be able to ascertain using no more than routine experimentation, many equivalents to the specific embodiments of the invention described herein. Such equivalents are intended to be encompassed by the following claims.

All references, including patent documents, disclosed herein are incorporated by reference in their entirety.

TABLE 1

| SEQ ID NO DNA | SEQ ID NO protein | *M. grisea* identifier | *S. cerevisiae* identifier | Function (based on yeast database) |
|---|---|---|---|---|
| 1 and 41 | 2 | MG00170.4 | YPR103W | 20S proteasome beta-type subunit, responsible for the chymotryptic activity of the proteasome |
| 3 and 42 | 4 | MG00884.4 | YER021W | Essential, non-ATPase regulatory subunit of the 26S proteasome lid, similar to the p58 subunit of the human 26S proteasome; temperature-sensitive alleles cause metaphase arrest, suggesting a role for the proteasome in cell cycle control |
| 5 and 43 | 6 | MG07031.4 | YER012W | 20S proteasome beta-type subunit; localizes to the nucleus throughout the cell cycle |
| 7 and 44 | 8 | MG04484.4 | YOL120C | Protein component of the large (60S) ribosomal subunit, identical to Rpl18Bp and has similarity to rat L18 ribosomal protein; intron of RPL18A pre-mRNA forms stem-loop structures that are a target for Rnt1p cleavage leading to degradation |
| 9 and 45 | 10 | MG02946.4 | YJL203W | Subunit of the SF3a splicing factor complex, required for spliceosome assembly |
| 11 and 46 | 12 | MG07472.4 | YAL032C | Ortholog of human transcriptional coactivator SKIP, can activate transcription of a reporter gene; interacts with splicing factors Prp22p and Prp46p |
| 17 and 49 | 18 | MG06292.4 | YBL084C | Subunit of the Anaphase-Promoting Complex/Cyclosome (APC/C), which is a ubiquitin-protein ligase required for degradation of anaphase inhibitors, including mitotic cyclins, during the metaphase/anaphase transition |
| 13 and 47 | 14 | MG03668.4 | YLR347C | Karyopherin beta, forms a dimeric complex with Srp1p (Kap60p) that mediates nuclear import of cargo proteins via a nuclear localization signal (NLS), interacts with nucleoporins to guide transport across the nuclear pore complex |
| 15 and 48 | 16 | MG10192.4 | YBR079C | Subunit of the core complex of translation initiation factor 3(eIF3), essential for translation; part of a subcomplex (Prt1p-Rpg1p-Nip1p) that stimulates binding of mRNA and tRNA(i)Met to ribosomes |
| 39 and 60 | 40 | MG00604.4 | YFL037W | Beta-tubulin; associates with alpha-tubulin to form tubulin dimer, which polymerizes to form microtubules |
| 29 and 55 | 30 | MG05169.4 | YJL087C | TRL1 encodes tRNA ligase, which is essential for tRNA splicing. Trl1p has phosphodiesterase, polynucleotide kinase, and ligase activities; each activity resides in a different domain. In tRNA processing, an intron is removed from the tRNA transcript by the multisubunit tRNA splicing endonuclease (encoded by SEN2, SEN15, SEN34, and SEN54); the resulting half-molecules are joined by Trl1p. Deletion of TRL1 is lethal; tRNA splicing intermediates accumulate in cells depleted of Trl1p or in trl1 temperature-sensitive mutants at the restrictive temperature. |
| 23 and 52 | 24 | MG04056.4 | YDR407C | Component of the targeting complex (TRAPP) involved in ER to Golgi membrane traffic. Null is inviable. |
| 21 and 51 | 22 | MG08911.4 | YJL039C | Essential structural subunit of the nuclear pore complex (NPC), localizes to the nuclear periphery of nuclear pores, homologous to human p205. Null inviable. |
| 25 and 53 | 26 | MG06314.4 | YGR047C | Transcription factor tau (TFIIIC) subunit 131. |
| 27 and 54 | 28 | MG08863.4 | YKL033W | The authentic, non-tagged protein was localized to the mitochondria. |
| 31 and 56 | 32 | MG07222.4 | YPR175W | Second largest subunit of DNA polymerase II (DNA polymerase epsilon), required for normal yeast chromosomal replication; expression peaks at the G1/S phase boundary; potential Cdc28p substrate. Null mutant is inviable; conditional mutant shows defects in DNA replication. |
| 37 and 59 | 38 | MG01760.4 | YJL085W | Essential 70 kDa subunit of the exocyst complex (Sec3p, Sec5p, Sec6p, Sec8p, Sec10p, Sec15p, Exo70p, and Exo84p), which has the essential function of mediating polarized targeting of secretory vesicles to active sites of exocytosis. Null is also inviable. |
| 19 and 50 | 20 | MG07116.4 | YIL129C | Identified in a hunt for mutants that activate OCH1 transcription; Transcriptional Activator of OCH1 |
| 33 and 57 | 34 | MG03872.4 | YJL010C | RNA binding protein involved in RNA processing. Protein required for cell viability. |
| 35 and 58 | 36 | MG04185.4 | YBL034C | Component of the mitotic spindle that binds to interpolar microtubules and plays an essential role in their ability to provide an outward force on the spindle poles. Null mutant shows defects in spindle assembly. |
| 556 and 486 | 459 | MG09222.5 | YGL123W | Protein component of the small (40S) subunit, essential for control of translational accuracy; has similarity to *E. coli* S5 and rat S2 ribosomal proteins. |
| 460 and 487 | 461 | MG00961.4 | YLR212C | Gamma-tubulin, involved in nucleating microtubules from both the cytoplasmic and nuclear faces of the spindle pole body |
| 462 and 488 | 463 | MG02952.5 | YBR189W | Ribosomal protein S9 |
| 464 and 489 | 465 | MG04095.5 | YLR025W | Involved in intracellular protein transport (carrier) |
| 466 and 490 | 467 | contig2.561.g35 | YJR145C/ YHR203C | Ribosomal protein S4 |
| 468 and 491 | 469 | contig2.887.g4 | YGL137W | RNA polymerase II 140 kD subunit |
| 470 and 492 | 471 | MG05193.5 | YDL126C | Transitional endoplasmatic reticulum ATPase TER94, Golgi organization and biogenesis |
| 472 and 493 | 473 | MG09952.5 | YLR293C | Putative RAN small monomeric GTPase, cell adhesion |
| 474 and 494 | 475 | MG06910.5 | YPR181C | GTPase activator, ER to Golgi protein transport, component of the Golgi stack |
| 476 and 495 | 477 | contig2.1499.g3 | YDL185W | vATPase |

TABLE 1-continued

| SEQ ID NO DNA | SEQ ID NO protein | *M. grisea* identifier | *S. cerevisiae* identifier | Function (based on yeast database) |
|---|---|---|---|---|
| 478 and 496 | 479 | MG04829.5 | YGL147C | GTPase activator, involved in intracellular protein transport |
| 480 and 497 | 481 | MG5858.4 | YFR004W | Proteasome regulatory particle, lid subcomplex, rpn11 |
| 482 and 498 | 483 | contig2.1053.g5 | YBR084C-A/ YBL027W | Ribosomal protein L19 |
| 484 and 499 | 485 | contig2.875.g14 | YOR151C | COPI vesicle coat; involved in Golgi to ER intracellular protein transport |

TABLE 2

| *M. grisea* Identifier | SEQ ID NO | Orthologue Identifier (“Accession nr”. “Version nr”) | Ortholoque Species |
|---|---|---|---|
| MG00170.4 | 210 | XM_387062.1 | *Gibberella zeae* PH-1 |
| | 214 | XM_745627.1 | *Aspergillus fumigatus* |
| | 229 | XM_446439.1 | *Candida glabrata* |
| | 230 | DR709833.1 | *Aspergillus niger* |
| | 233 | XM_709731.1 | *Candida albicans* |
| | 236 | CA582255.1 | *Paracoccidioides brasiliensis* |
| | 243 | AJ636229.1 | *Mycosphaerella graminicola* |
| | 245 | XM_408069.1 | *Aspergillus nidulans* FGSC A4 |
| | 254 | DN795961.1 | *Sclerotinia sclerotiorum* |
| | 271 | XM_571562.1 | *Cryptococcus neoformans* var. |
| | 272 | XM_402498.1 | *Ustilago maydis* |
| | 296 | AW790794.1 | *Blumeria graminis* f. sp. |
| | 301 | CO136158.1 | *Aspergillus flavus* |
| | 321 | CV968020.1 | *Phytophthora infestans* |
| | 324 | BI189607.1 | *Fusarium sporotrichioides* |
| | 406 | BW644197.1 | *Fusarium oxysporum* f. sp. |
| | 409 | XM_369074.1 | *Magnaporthe grisea* 70-15 |
| MG00604.4 | 208 | XM_713903.1 | *Candida albicans* |
| | 215 | AL117033.1 | *Botryotinia fuckeliana* |
| | 216 | CN239178.1 | *Paracoccidioides brasiliensis* |
| | 217 | DR046029.1 | *Phaeosphaeria nodorum* |
| | 219 | DR709051.1 | *Aspergillus niger* |
| | 222 | DR439037.1 | *Phytophthora parasitica* |
| | 223 | CV966689.1 | *Phytophthora infestans* |
| | 224 | DR439037.1 | *Phytophthora parasitica* |
| | 231 | CO138830.1 | *Aspergillus flavus* |
| | 234 | BQ110893.1 | *Verticillium dahliae* |
| | 241 | BI191775.1 | *Fusarium sporotrichioides* |
| | 244 | BI191775.1 | *Fusarium sporotrichioides* |
| | 249 | DN477093.1 | *Alternaria brassicicola* |
| | 325 | BQ621948.1 | *Conidiobolus coronatus* |
| | 329 | AW789096.1 | *Blumeria graminis* f. sp. |
| | 338 | AY337716.1 | *Fusarium oxysporum* f. sp. |
| | 410 | AF218256.1 | *Pythium ultimum* |
| | 411 | AF257329.1 | *Leptosphaeria maculans* |
| | 412 | AY763789.1 | *Trichophyton rubrum* |
| | 413 | X81961.1 | *Erysiphe pisi* |
| | 414 | XM_368640.1 | *Magnaporthe grisea* 70-15 |
| | 415 | XM_389706.1 | *Gibberella zeae* PH-1 |
| | 416 | XM_403443.1 | *Ustilago maydis* |
| | 417 | XM_405319.1 | *Aspergillus nidulans* FGSC A4 |
| | 418 | XM_448766.1 | *Candida glabrata* |
| | 419 | XM_569650.1 | *Cryptococcus neoformans* var. |
| | 420 | XM_747363.1 | *Aspergillus fumigatus* |
| MG00884.4 | 220 | AL116400.1 | *Botryotinia fuckeliana* |
| | 239 | CO145866.1 | *Aspergillus flavus* |
| | 250 | XM_716188.1 | *Candida albicans* |
| | 251 | XM_716459.1 | *Candida albicans* |
| | 255 | XM_566480.1 | *Cryptococcus neoformans* var. |
| | 256 | XM_400867.1 | *Ustilago maydis* |
| | 289 | AJ639036.1 | *Mycosphaerella graminicola* |
| | 294 | DR706305.1 | *Aspergillus niger* |
| | 312 | CN251795.1 | *Paracoccidioides brasiliensis* |
| | 330 | CF844359.1 | *Phytophthora sojae* |
| | 366 | CV959275.1 | *Phytophthora infestans* |
| | 421 | XM_368360.1 | *Magnaporthe grisea* 70-15 |
| | 422 | XM_386221.1 | *Gibberella zeae* PH-1 |
| | 423 | XM_406904.1 | *Aspergillus nidulans* FGSC A4 |
| | 424 | XM_749902.1 | *Aspergillus fumigatus* |
| MG01760.4 | 263 | XM_750434.1 | *Aspergillus fumigatus* |
| | 267 | XM_750434.1 | *Aspergillus fumigatus* |

TABLE 2-continued

| *M. grisea* Identifier | SEQ ID NO | Orthologue Identifier (“Accession nr”. “Version nr”) | Ortholoque Species |
|---|---|---|---|
| | 275 | XM_410347.1 | *Aspergillus nidulans* FGSC A4 |
| | 335 | DR707382.1 | *Aspergillus niger* |
| | 355 | CO152071.1 | *Aspergillus flavus* |
| | 367 | AW180181.1 | *Mycosphaerella graminicola* |
| | 374 | BQ493216.1 | *Paracoccidioides brasiliensis* |
| | 403 | XM_399460.1 | *Ustilago maydis* |
| | 404 | XM_449482.1 | *Candida glabrata* |
| | 425 | XM_363834.1 | *Magnaporthe grisea* 70-15 |
| | 426 | XM_382095.1 | *Gibberella zeae* PH-1 |
| MG02946.4 | 207 | XM_389109.1 | *Gibberella zeae* PH-1 |
| | 225 | XM_408897.1 | *Aspergillus nidulans* FGSC A4 |
| | 276 | DR710305.1 | *Aspergillus niger* |
| | 278 | DR710305.1 | *Aspergillus niger* |
| | 287 | XM_749869.1 | *Aspergillus fumigatus* |
| | 336 | XM_397920.1 | *Ustilago maydis* |
| | 352 | CA582353.1 | *Paracoccidioides brasiliensis* |
| | 357 | XM_566533.1 | *Cryptococcus neoformans* var. |
| | 389 | XM_717783.1 | *Candida albicans* |
| | 405 | CV949205.1 | *Phytophthora infestans* |
| | 427 | XM_366870.1 | *Magnaporthe grisea* 70-15 |
| MG03668.4 | 209 | XM_570418.1 | *Cryptococcus neoformans* var. |
| | 237 | XM_446411.1 | *Candida glabrata* |
| | 252 | XM_708682.1 | *Candida albicans* |
| | 268 | CN239360.1 | *Paracoccidioides brasiliensis* |
| | 283 | BQ110666.1 | *Verticillium dahliae* |
| | 290 | DR703485.1 | *Aspergillus niger* |
| | 304 | AJ635696.1 | *Mycosphaerella graminicola* |
| | 361 | DN478339.1 | *Alternaria brassicicola* |
| | 384 | CF843394.1 | *Phytophthora sojae* |
| | 393 | CV916642.1 | *Phytophthora infestans* |
| | 428 | XM_361125.1 | *Magnaporthe grisea* 70-15 |
| | 429 | XM_389630.1 | *Gibberella zeae* PH-1 |
| | 430 | XM_399990.1 | *Ustilago maydis* |
| | 431 | XM_405043.1 | *Aspergillus nidulans* FGSC A4 |
| | 432 | XM_747845.1 | *Aspergillus fumigatus* |
| MG03872.4 | 319 | XM_387214.1 | *Gibberella zeae* PH-1 |
| | 328 | XM_749415.1 | *Aspergillus fumigatus* |
| | 377 | CO147563.1 | *Aspergillus flavus* |
| | 381 | XM_706881.1 | *Candida albicans* |
| | 402 | CF645358.1 | *Ustilago maydis* |
| | 433 | XM_361398.1 | *Magnaporthe grisea* 70-15 |
| MG04056.4 | 206 | XM_410670.1 | *Aspergillus nidulans* FGSC A4 |
| | 212 | XM_742501.1 | *Aspergillus fumigatus* |
| | 376 | CO151047.1 | *Aspergillus flavus* |
| | 378 | DR164852.1 | *Paracoccidioides brasiliensis* |
| | 386 | XM_714273.1 | *Candida albicans* |
| | 394 | DN477226.1 | *Alternaria brassicicola* |
| | 408 | XM_570072.1 | *Cryptococcus neoformans* var. |
| | 434 | XM_361582.1 | *Magnaporthe grisea* 70-15 |
| | 435 | XM_386415.1 | *Gibberella zeae* PH-1 |
| MG04185.4 | 280 | XM_747547.1 | *Aspergillus fumigatus* |
| | 343 | XM_405132.1 | *Aspergillus nidulans* FGSC A4 |
| | 345 | XM_402160.1 | *Ustilago maydis* |
| | 346 | XM_708987.1 | *Candida albicans* |
| | 354 | AL111352.1 | *Botryotinia fuckeliana* |
| | 370 | BI187889.1 | *Fusarium sporotrichioides* |
| | 372 | BI187889.1 | *Fusarium sporotrichioides* |
| | 391 | XM_569869.1 | *Cryptococcus neoformans* var. |
| | 436 | XM_361711.1 | *Magnaporthe grisea* 70-15 |
| | 437 | XM_386367.1 | *Gibberella zeae* PH-1 |
| MG04484.4 | 221 | XM_362039.1 | *Magnaporthe grisea* 70-15 |

TABLE 2-continued

| *M. grisea* Identifier | SEQ ID NO | Orthologue Identifier ("Accession nr". "Version nr") | Ortholoque Species |
|---|---|---|---|
| | 257 | BU064817.1 | *Gibberella zeae* |
| | 258 | XM_390042.1 | *Gibberella zeae* PH-1 |
| | 260 | CO134330.1 | *Aspergillus flavus* |
| | 261 | XM_409937.1 | *Aspergillus nidulans* FGSC A4 |
| | 264 | CO140779.1 | *Aspergillus flavus* |
| | 265 | DR706673.1 | *Aspergillus niger* |
| | 266 | XM_749981.1 | *Aspergillus fumigatus* |
| | 269 | CD488085.1 | *Ustilago maydis* |
| | 273 | CN241271.1 | *Paracoccidioides brasiliensis* |
| | 284 | DT932969.1 | *Leptosphaeria maculans* |
| | 288 | AL113061.1 | *Botryotinia fuckeliana* |
| | 291 | AJ638244.1 | *Mycosphaerella graminicola* |
| | 305 | BQ110718.1 | *Verticillium dahliae* |
| | 317 | CF845455.1 | *Phytophthora sojae* |
| | 326 | CV949997.1 | *Phytophthora infestans* |
| | 333 | XM_718100.1 | *Candida albicans* |
| | 337 | DN478895.1 | *Alternaria brassicicola* |
| | 341 | XM_570672.1 | *Cryptococcus neoformans* var. |
| | 342 | DR438661.1 | *Phytophthora parasitica* |
| | 358 | BQ283973.1 | *Blumeria graminis* f. sp. |
| MG05169.4 | 240 | XM_449481.1 | *Candida glabrata* |
| | 297 | XM_716256.1 | *Candida albicans* |
| | 308 | XM_398486.1 | *Ustilago maydis* |
| | 331 | CN239627.1 | *Paracoccidioides brasiliensis* |
| | 349 | XM_570638.1 | *Cryptococcus neoformans* var. |
| | 368 | AL116927.1 | *Botryotinia fuckeliana* |
| | 438 | XM_359608.1 | *Magnaporthe grisea* 70-15 |
| | 439 | XM_391770.1 | *Gibberella zeae* PH-1 |
| | 440 | XM_405433.1 | *Aspergillus nidulans* FGSC A4 |
| | 441 | XM_747243.1 | *Aspergillus fumigatus* |
| MG06292.4 | 226 | X59269.1 | *Emericella nidulans* |
| | 227 | XM_750103.1 | *Aspergillus fumigatus* |
| | 282 | XM_566728.1 | *Cryptococcus neoformans* var. |
| | 285 | XM_712829.1 | *Candida albicans* |
| | 286 | XM_712763.1 | *Candida albicans* |
| | 353 | XM_399704.1 | *Ustilago maydis* |
| | 373 | CO142798.1 | *Aspergillus flavus* |
| | 399 | CN240192.1 | *Paracoccidioides brasiliensis* |
| | 442 | XM_369777.1 | *Magnaporthe grisea* 70-15 |
| | 443 | XM_385668.1 | *Gibberella zeae* PH-1 |
| MG06314.4 | 293 | XM_385552.1 | *Gibberella zeae* PH-1 |
| | 295 | XM_385552.1 | *Gibberella zeae* PH-1 |
| | 320 | XM_404544.1 | *Aspergillus nidulans* FGSC A4 |
| | 369 | XM_745154.1 | *Aspergillus fumigatus* |
| | 383 | XM_444925.1 | *Candida glabrata* |
| | 390 | CA581516.1 | *Paracoccidioides brasiliensis* |
| | 392 | XM_397947.1 | *Ustilago maydis* |
| | 395 | XM_567461.1 | *Cryptococcus neoformans* var. |
| | 407 | DR439107.1 | *Phytophthora parasitica* |
| | 444 | XM_369799.1 | *Magnaporthe grisea* 70-15 |
| MG07031.4 | 211 | XM_367106.1 | *Magnaporthe grisea* 70-15 |
| | 238 | DR668205.1 | *Gibberella moniliformis* |
| | 242 | CN811486.1 | *Gibberella zeae* |
| | 247 | DR710271.1 | *Aspergillus niger* |
| | 248 | XM_746981.1 | *Aspergillus fumigatus* |
| | 253 | AL111548.1 | *Botryotinia fuckeliana* |
| | 259 | CN248132.1 | *Paracoccidioides brasiliensis* |
| | 270 | CO151671.1 | *Aspergillus flavus* |
| | 298 | XM_447214.1 | *Candida glabrata* |
| | 299 | XM_408594.1 | *Aspergillus nidulans* FGSC A4 |
| | 302 | XM_716840.1 | *Candida albicans* |
| | 306 | BI201970.1 | *Fusarium sporotrichioides* |
| | 316 | XM_401794.1 | *Ustilago maydis* |
| | 332 | XM_569789.1 | *Cryptococcus neoformans* var. |
| | 350 | CV222840.1 | *Phanerochaete chrysosporium* |
| | 356 | DR440327.1 | *Phytophthora parasitica* |
| | 359 | BE775707.1 | *Phytophthora infestans* |
| | 360 | DR440327.1 | *Phytophthora parasitica* |
| | 379 | DN479774.1 | *Alternaria brassicicola* |
| MG07116.4 | 303 | XM_716554.1 | *Candida albicans* |
| | 363 | CA582713.1 | *Paracoccidioides brasiliensis* |
| | 364 | XM_397938.1 | *Ustilago maydis* |
| | 445 | XM_367191.1 | *Magnaporthe grisea* 70-15 |
| | 446 | XM_389963.1 | *Gibberella zeae* PH-1 |

TABLE 2-continued

| *M. grisea* Identifier | SEQ ID NO | Orthologue Identifier ("Accession nr". "Version nr") | Ortholoque Species |
|---|---|---|---|
| | 447 | XM_404731.1 | *Aspergillus nidulans* FGSC A4 |
| | 448 | XM_745894.1 | *Aspergillus fumigatus* |
| MG07222.4 | 277 | XM_744655.1 | *Aspergillus fumigatus* |
| | 300 | XM_411576.1 | *Aspergillus nidulans* FGSC A4 |
| | 351 | CN247150.1 | *Paracoccidioides brasiliensis* |
| | 385 | XM_446786.1 | *Candida glabrata* |
| | 387 | XM_400375.1 | *Ustilago maydis* |
| | 396 | XM_571676.1 | *Cryptococcus neoformans* var. |
| | 397 | XM_714233.1 | *Candida albicans* |
| | 449 | XM_367297.1 | *Magnaporthe grisea* 70-15 |
| | 450 | XM_390075.1 | *Gibberella zeae* PH-1 |
| MG07472.4 | 218 | XM_386292.1 | *Gibberella zeae* PH-1 |
| | 279 | XM_742945.1 | *Aspergillus fumigatus* |
| | 292 | XM_412317.1 | *Aspergillus nidulans* FGSC A4 |
| | 307 | AL115094.1 | *Botryotinia fuckeliana* |
| | 314 | XM_572276.1 | *Cryptococcus neoformans* var. |
| | 318 | DR708959.1 | *Aspergillus niger* |
| | 322 | CO143369.1 | *Aspergillus flavus* |
| | 334 | XM_400233.1 | *Ustilago maydis* |
| | 347 | CV957053.1 | *Phytophthora infestans* |
| | 380 | CA581803.1 | *Paracoccidioides brasiliensis* |
| | 388 | XM_714102.1 | *Candida albicans* |
| | 451 | XM_367561.1 | *Magnaporthe grisea* 70-15 |
| MG08863.4 | 281 | XM_385749.1 | *Gibberella zeae* PH-1 |
| | 311 | XM_750141.1 | *Aspergillus fumigatus* |
| | 339 | XM_410205.1 | *Aspergillus nidulans* FGSC A4 |
| | 362 | AL111561.1 | *Botryotinia fuckeliana* |
| | 375 | XM_569100.1 | *Cryptococcus neoformans* var. |
| | 400 | BQ499912.1 | *Paracoccidioides brasiliensis* |
| | 401 | XM_448856.1 | *Candida glabrata* |
| | 452 | XM_364018.1 | *Magnaporthe grisea* 70-15 |
| MG08911.4 | 213 | XM_748293.1 | *Aspergillus fumigatus* |
| | 313 | BI191623.1 | *Fusarium sporotrichioides* |
| | 348 | CO143726.1 | *Aspergillus flavus* |
| | 382 | DR706257.1 | *Aspergillus niger* |
| | 398 | XM_447745.1 | *Candida glabrata* |
| | 453 | XM_364066.1 | *Magnaporthe grisea* 70-15 |
| | 454 | XM_385694.1 | *Gibberella zeae* PH-1 |
| MG10192.4 | 228 | XM_403070.1 | *Ustilago maydis* |
| | 232 | XM_706539.1 | *Candida albicans* |
| | 235 | XM_706539.1 | *Candida albicans* |
| | 246 | DR701435.1 | *Aspergillus niger* |
| | 262 | BQ110649.1 | *Verticillium dahliae* |
| | 274 | AL114181.1 | *Botryotinia fuckeliana* |
| | 309 | BI201406.1 | *Fusarium sporotrichioides* |
| | 310 | XM_570890.1 | *Cryptococcus neoformans* var. |
| | 315 | BW644576.1 | *Fusarium oxysporum* f. sp. |
| | 323 | DR045681.1 | *Phaeosphaeria nodorum* |
| | 327 | BQ622080.1 | *Conidiobolus coronatus* |
| | 340 | BE187972.1 | *Cladosporium fulvum* |
| | 344 | CN242658.1 | *Paracoccidioides brasiliensis* |
| | 365 | AJ637851.1 | *Mycosphaerella graminicola* |
| | 371 | BE776281.1 | *Phytophthora infestans* |
| | 455 | XM_365972.1 | *Magnaporthe grisea* 70-15 |
| | 456 | XM_387413.1 | *Gibberella zeae* PH-1 |
| | 457 | XM_406880.1 | *Aspergillus nidulans* FGSC A4 |
| | 458 | XM_745176.1 | *Aspergillus fumigatus* |

Table 3A

| Target gene ID | PCR | Specific Primer FW | Specific Primer RV | cDNA clone |
|---|---|---|---|---|
| MG00884.4 | A | (SEQ ID NO: 61) atgaaggacgagacatcacg | (SEQ ID NO: 62) ttacatgccctcgaattctcc | (SEQ ID NO: 3) MG00884.4TA/02A#01 |
| MG04484.4 | B | (SEQ ID NO: 63) atgggtatcgatcttaagaagcacc | (SEQ ID NO: 64) ttagaccttgaaaccacgcg | (SEQ ID NO: 186) MG04484.4TA/04A#07 |
| MG07472.4 | B | (SEQ ID NO: 65) atgcactcgccgccgcggaagttg | (SEQ ID NO: 66) tcaatcgtcgtcctccaccc | (SEQ ID NO: 11) MG07472.4TA/07A#01 |
| MG06292.4 | C | (SEQ ID NO: 67) atggcacctggtagcagtg | (SEQ ID NO: 68) tcagccatcaccgttgggtag | (SEQ ID NO: 17) MG06292.4TA/08A#03 |
| MG03668.4 | D | (SEQ ID NO: 69) atggcgacgtcagacatc | (SEQ ID NO: 70) tcaagtctgctgcatgac | (SEQ ID NO: 13) MG03668.4TA/09A#01 and MG03668.4TA/09B#05 |
| | D | (SEQ ID NO: 71) atggcgacgtcagacatc | (SEQ ID NO: 72) tcaagtctgctgcatgac | |
| MG05169.4 | E | (SEQ ID NO: 73) taaaatggccaccgatgcccaagggcct | (SEQ ID NO: 74) ccctcagaattttgacaggaccgcc | (SEQ ID NO: 29) MG05169.4TA/11A#12 and MG05169.4TA/11B#15 |
| | E | (SEQ ID NO: 75) taaaatggccaccgatgcccaagggcct | (SEQ ID NO: 76) ccctcagaattttgacaggaccgcc | |
| MG03872.4 | F | (SEQ ID NO: 77) atgggtaaacgaaagagcgaacag | (SEQ ID NO: 78) tcactcatctgcctcctgcttttttc | (SEQ ID NO: 33) MG03872.4TA/30B#01 |
| MG00604.4 | G | (SEQ ID NO: 557) atgcgtgaaattgttcaccttcag | (SEQ ID NO: 558) ctactcctcgccctcaagaggggc | (SEQ ID NO: 39) FL b-tub/pBF089 |

Table 3B

| Target gene ID | PCR | Specific Primer FW | Specific Primer RV | Fragment |
|---|---|---|---|---|
| MG09222.5 | G | (SEQ ID NO: 500) tgactccgagggccacgttggtct | (SEQ ID NO: 501) gctcctgatgagcttggtctcctt | (SEQ ID NO: 530) pBF076/TA5 |
| MG00961.4 | G | (SEQ ID NO: 559) gtctctactgttatgtctgccagc | (SEQ ID NO: 560) tcaccccattctccgatccgtctc | (SEQ ID NO: 561) Exon6 g-tub/pBF093 |
| MG02952.4 | G | (SEQ ID NO: 502) gtctcaagaacaagcgtgaggtctgg | (SEQ ID NO: 503) gccttctttctgaggacacgg | (SEQ ID NO: 541) pBF077/TA14 |
| MG04095.4 | G | (SEQ ID NO: 504) catcttggggctgcgatcaca | (SEQ ID NO: 505) gattgcctcgtttccgagctgat | (SEQ ID NO: 542) pBF078/TA15 |
| contig2.561.g35 | G | (SEQ ID NO: 506) gcaaggtccgcaccgactcg | (SEQ ID NO: 507) gcacaatgttgaagccaccatcg | (SEQ ID NO: 543) pBF079/TA17 |
| contig2.887.g4 | G | (SEQ ID NO: 508) cctcttgcgtgagcatggatacca | (SEQ ID NO: 509) cgatcttggtcttgttcctacatggc | (SEQ ID NO: 544) pBF080/TA18 |
| MG05193.4 | G | (SEQ ID NO: 510) ggagcaggtccagtacccagtcg | (SEQ ID NO: 511) ggtcgctccaataacgaacacgtt | (SEQ ID NO: 545) pBF081/TA19 |
| MG09952.4 | G | (SEQ ID NO: 512) gccagtgcggtatcatcatgtttg | (SEQ ID NO: 513) cttcatcatcatcatcgggcagg | (SEQ ID NO: 546) pBF082/TA20 |
| MG06910.4 | G | (SEQ ID NO: 514) caggtcggtcttctggagatgaaagg | (SEQ ID NO: 515) cagatgagtgctggtaatatgtg agaaattg | (SEQ ID NO: 547) pBF083/TA21 |
| contig2.1499.g3 | G | (SEQ ID NO: 516) cctgtgactacatcgaccctgtcca | (SEQ ID NO: 517) gcctcgtcgtggaaacccatc | (SEQ ID NO: 548) pBF084/TA22 |
| MG04829.4 | G | (SEQ ID NO: 518) cgttatcggcatcgagattcacca | (SEQ ID NO: 519) cgagacgtacataccatccaaga acttacg | (SEQ ID NO: 549) pBF085/TA23 |
| MG5858.4 | G | (SEQ ID NO: 520) cgagtttgtcgatgacttcacag tacg | (SEQ ID NO: 521) caatgcttgaatcgagggtttgttg | (SEQ ID NO: 550) pBF086/TA25 |

-continued

| | | | | |
|---|---|---|---|---|
| contig2.1053.g5 | G | (SEQ ID NO: 522) cgtccgttttggactgtggca | (SEQ ID NO: 523) gcacggtggatgtgctcaacaag | (SEQ ID NO: 551) pBF087/TA27 |
| contig2.875.g14 | G | (SEQ ID NO: 524) ggtggtcctcgcagcttcaatc | (SEQ ID NO: 525) gaggaaggtcttgatctggctaatggt | (SEQ ID NO: 552) pBF088/TA28 |

TABLE 4

| Target gene ID | Exon | PCR | Specific Primer FW | Specific Primer RV | cDNA clone |
|---|---|---|---|---|---|
| MG00170.4 | 1 | A | (SEQ ID NO: 79) 1 FP: atggacaccctggtagcccgctac | (SEQ ID NO: 80) 1 Ex1 RP: atgtgctactggcggaacc | (SEQ ID NO: 184) MG00170.4TA/01A#04 |
| | 2 | A | (SEQ ID NO: 81) Ex2 FP: ccctcatcttggctccgca | (SEQ ID NO: 82) 1 RP: ctagtccagcgcactcgtaac | |
| MG07031.4 | 1 | synthetic | | | (SEQ ID NO: 5) |
| | 2 | synthetic | | | MG07031.4TA/03A#05 |
| | 3 | B | (SEQ ID NO: 83) 3 Ex3 FP: gttcttttggggatcacgggcaa | (SEQ ID NO: 84) 3 Ex3 RP: tggtgtctccaggctcgc | and MG07031.4TA/03B#02 |
| | 4 | B | (SEQ ID NO: 85) 3 Ex4 FP: tccagtttgcggagtaca | (SEQ ID NO: 86) 3 Ex4 RP: tgagcatatccatgcgca | |
| | 5 | B | (SEQ ID NO: 87) 3 Ex5 FP: gtactactgcctctccat | (SEQ ID NO: 88) 3 Ex5 RP: tcaagcactctttacaatcttg | |
| MG02946.4 | 1 | C | (SEQ ID NO: 89) 6 FP: tttatggcgaccaacggcgat | (SEQ ID NO: 90) 6 Ex1 RP: tcctcatgtgctcctcccactc | (SEQ ID NO: 188) MG02946.4TA/06A#1 |
| | 2 | D | (SEQ ID NO: 91) 6 Ex2 FP: tcgaactgctggatccca | (SEQ ID NO: 92) 6 RP: ccgttattccttttgtctcc | |
| MG10192.4 | 2 | E | (SEQ ID NO: 93) 10 FP: atgcctcctccaccgcatc | (SEQ ID NO: 94) 10 Ex2 RP: ctctatcgtgccgacatttgtg | (SEQ ID NO: 15) MG10192.4TA/10A-EXON2#H1 |
| | 3 | F | (SEQ ID NO: 95) 10 Ex3 FP: cttgttttgaaaaaattcatcgagctcgccgc | (SEQ ID NO: 96) 10 RP: ctagttcccggcattctcacg | and MG10192.4TA/10B-EXON3#09 |

Table 5A

| Target gene (ID) | Fragment of the target gene | In vitro (IV) or Plant expressed (PE) |
|---|---|---|
| MG00170.4 (nt 11-306) | (SEQ ID NO: 97) tggtagcccgctacagccgcccggcttaccagcagaacgagacattcacagaagatgatcagcaagacctttgcgattccgtcccaagtctttca ctcaagtttgcggttccgccagtagcacatccctcatcttggctccgcacagcaacggacgaccacgcaaacccaaactgccccatcaagatcg cacacggaacgacgacgctcgctttcaggtttcagggaggcatcatcgttgcgaccgactctcgtgccaccgccggcaactggattgcttcgcag acggtcaagaag (296 bp) | PE |
| MG00170.4 (nt 1-835) | (SEQ ID NO: 98) atggacaccctggtagcccgctacagccgcccggcttaccagcagaacgagacattcacagaagatgatcagcaagacctttgcgattccgtcc caagtctttcactcaagtttgcggttccgccagtagcacatccctcatcttggctccgcacagcaacggacgaccacgcaaacccaaactgcccc atcaagatcgcacacggaacgacgacgctcgctttcaggtttcagggaggcatcatcgttgcgaccgactctcgtgccaccgccggcaactggat tgcttcgcagacggtcaagaaggtcatcgagatcaactcttgcctgctcggcaccatggccggcggtgccgcagactgccagtactggctcgcct ggctgggcatgcagtgccgtctgcacgagctccgccacaagcgccgcatctcggtcgccgccgcctccaagattctcgccaacctcgtctacca gtacaagggcatgggcctcagcatgggtaccatgtgcgccggcgtcaccaaggaggagggtcccgccctgtactacatcgacagcgacggca ccaggcttgccggcaatctgttctgtgtgggatccggtcagacctttgcctatggtgtgctggatgccgagtacaagtacgacctgtcggatgaggat gcgctcgagctcggccgcaggagcattctcgccgccacccacagggatgcctactccggtggttttatcaacttgtaccacgtcaaggaggacgg ttgggtcaagcacggattcaacgacacgaaccctatcttctggaagactaagctggagaagggcgagtttaccaacg (835 bp) | PE |
| MG00170.4 (nt 1-400) | (SEQ ID NO: 526) atggacaccctggtagcccgctacagccgcccggcttaccagcagaacgagacattcacagaagatgatcagcaagacctttgcgattccgtcc caagtctttcactcaagtttgcggttccgccagtagcacatccctcatcttggctccgcacagcaacggacgaccacgcaaacccaaactgcccca tcaagatcgcacacggaacgacgacgctcgctttcaggtttcagggaggcatcatcgttgcgaccgactctcgtgccaccgccggcaactggattg cttcgcagacggtcaagaaggtcatcgagatcaactcttgcctgctcggcaccatggccggcggtgccgcagactgccagtactggctcgcctgg ctgggcatgcagtgccgtctgcacgagctccgccacaagcgccgcatctcggtcgccgccgcctccaagattctcgccaacctcgtctaccagtac aagggcatgggcctcagcatggg (500 bp) | IV |
| MG00884.4 (nt 852-1139) | (SEQ ID NO: 99) cgacctgctcgtctcacatacacagttccccgagaatgctgcaaacaaccaagttgcgcggtatctctaccttggtcggattcgcgccatacag ctgcgctacacggaggcacacgagcacctgacggctgcgacgcggaaggcaccgagctctaactgcgcggttggtttctcgcagacggccac caagcttttgctggtggttgagcttcttatgggcgatattcctgatcgcgcgaccttccgccaaccgaccctcgaggaggcactgcacccttacttcct (288 bp) | PE |
| MG00884.4 (nt 845-1044) | (SEQ ID NO: 100) accaggccgacctgctcgtctcacatacacagttccccgagaatgctgcaaacaaccaagttgcgcggtatctctaccttggtcggattcgcg ccatacagctgcgctacacggaggcacacgagcacctgacggctgcgacgcggaaggcaccgagctctaactgcgcggttggtttctcgcaga cggccaccaag (200 bp) | IV: 33% (see FIG. 1b) |
| MG00884.4 (nt 845-1244) | (SEQ ID NO: 527) accaggccgacctgctcgtctcacatacacagttccccgagaatgctgcaaacaaccaagttgcgcggtatctctaccttggtcggattcgcgc catacagctgcgctacacggaggcacacgagcacctgacggctgcgacgcggaaggcaccgagctctaactgcgcggttggtttctcgcagac ggccaccaagcttttgctggtggttgagcttcttatgggcgatattcctgatcgcgcgaccttccgccaaccgaccctcgaggaggcactgcaccctt acttcctgctagtccaggctgttcgggtcggtaacctcgacaacttcgagacgaccattgcggaccacgccgatactttccgcaaggacggaacct acaccctcatcctccg (400 bp) | IV |
| MG07031.4 (nt 261-543) | (SEQ ID NO: 101) ggagtacatcatggcaaacgcgaagctctattcgatgcgtaacgagaccgatctttcaccgtccgcattggcgcattacgtccgtggcgagcttgc ctcgagcttgaggtcgcggaagccatacacagtcaacctcctcttgggcggtgtcgaccccatcacacacaagccgagcctctactggctggact accttgcggctctggcgccggtcccatatgctgcgcatggatatgctcagtactactgcctctccatcctcgacaaacatcaccatcccgat (283 | PE |

-continued

| | | |
|---|---|---|
| | bp) | |
| MG07031.4 (nt 251-500) | (SEQ ID NO: 102)<br>tccagtttgcggagtacatcatggcaaacgcgaagctctattcgatgcgtaacgagaccgatctttcaccgtccgcattggcgcattacgtccgtgg<br>cgagcttgcctcgagcttgaggtcgcggaagccatacacagtcaacctcctcttgggcggtgtcgaccccatcacacacaagccgagcctctact<br>ggctggactaccttgcggctctggcgccggtcccatatgctgcgcatggatatgctca (250 bp) | IV: 43% (see FIG. 1c) |
| MG07031.4 (nt 251-650) | (SEQ ID NO: 528)<br>tccagtttgcggagtacatcatggcaaacgcgaagctctattcgatgcgtaacgagaccgatctttcaccgtccgcattggcgcattacgtccgtggc<br>gagcttgcctcgagcttgaggtcgcggaagccatacacagtcaacctcctcttgggcggtgtcgaccccatcacacacaagccgagcctctactg<br>gctggactaccttgcggctctggcgccggtcccatatgctgcgcatggatatgctcagtactactgcctctccatcctcgacaaacatcaccatcccg<br>atatcaccctgcaccagggtatcaagatcctgactatagtgcaccgacgagctgaagaggagattaccgattgacttcaaaggaatggtggtgaag<br>gcggtgacaaagga (400 bp) | IV |
| MG04484.4 (nt 7-276) | (SEQ ID NO: 103)<br>atcgatcttaagaagcaccacgtgcgcagcacgcaccgcaaggcccccaagagcgacaatgtctacctcaagctcttggtgaagctctaccgct<br>tcctggcccgcaggaccgactccagcttcaacaaggttgtccttcgccgcctctttatgtcgcgcaccaaccgccctcccgtctccctgtcgcgcatc<br>gcaggcaacctgaagaacggcaacgagaagaagaccgttgtcgttgtcggcaccgtcaccgacgacaaccgcctggtt (270 bp) | PE |
| MG04484.4 (nt 1-555) | (SEQ ID NO: 104)<br>atgggtatcgatcttaagaagcaccacgtgcgcagcacgcaccgcaaggcccccaagagcgacaatgtctacctcaagctcttggtgaagctct<br>accgcttcctggcccgcaggaccgactccagcttcaacaaggttgtccttcgccgcctctttatgtcgcgcaccaaccgccctcccgtctccctgtcg<br>cgcatcgcaggcaacctgaagaacggcaacgagaagaagaccgttgtcgttgtcggcaccgtcaccgacgacaaccgcctggttgagtgccc<br>caaggcccaggtcgctgcccttcgcttcaccgccaccgcccgtgcccgcatcgttgccgccggcggccaggccatcacccttgaccagctggct<br>cttgagaagcccactggtgccaacaccctcctcctccccaagaacgcccgtgaggctgtcaagcacttcggcttcggtccccacaagcacaaga<br>agccttacgtccagtccaagggccgcaagttcgagaaggcccgtggtcgcagacgatcgcgtggtttcaaggtctaa (555 bp) | PE |
| MG04484.4 (nt 211-409) | (SEQ ID NO: 105)<br>aagaacggcaacgagaagaagaccgttgtcgttgtcggcaccgtcaccgacgacaaccgcctggttgagtgccccaaggcccaggtcgctgc<br>ccttcgcttcaccgccaccgcccgtgcccgcatcgttgccgccggcggccaggccatcacccttgaccagctggctcttgagaagcccactggtg<br>ccaacaccctcc (199 bp) | IV: 30% (see FIG. 1d) |
| MG04484.4 (nt 1-400) | (SEQ ID NO: 529)<br>atgggtatcgatcttaagaagcaccacgtgcgcagcacgcaccgcaaggcccccaagagcgacaatgtctacctcaagctcttggtgaagctct<br>accgcttcctggcccgcaggaccgactccagcttcaacaaggttgtccttcgccgcctctttatgtcgcgcaccaaccgccctcccgtctccctgtcgc<br>gcatcgcaggcaacctgaagaacggcaacgagaagaagaccgttgtcgttgtcggcaccgtcaccgacgacaaccgcctggttgagtgcccc<br>aaggcccaggtcgctgcccttcgcttcaccgccaccgcccgtgcccgcatcgttgccgccggcggccaggccatcacccttgaccagctggctctt<br>gagaagcccactggtgcca (400 bp) | IV |
| MG02946.4 (nt 58-333) | (SEQ ID NO: 106)<br>actgcggccgcggcacagctcgacggcctcaggcctcccgagggcgtcatcattccgccacccggtgagatccgcgaggtgattgaaaagac<br>ggccgggtacgtggcgcgtggtggactgggcatcgagcagcgcctacgcgagaaccacagcgggaacccaaagttcagcttcgtcacgagc<br>cagagcgacgcgtacaatccgtactacgagtggcgcaaggccgagtacaaggccgggcgtggcacggcgctggcggctggtcgggcggatg<br>cg (276 bp) | PE |
| MG02946.4 (nt 1-400) | (SEQ ID NO: 531)<br>atggcgaccaacggcgatgctgctcccccggcgccggcggcagagacggcagctgcgactgcggccgcggcacagctcgacggcctcaggc<br>ctcccgagggcgtcatcattccgccacccggtgagatccgcgaggtgattgaaaagacggccgggtacgtggcgcgtggtggactgggcatcga<br>gcagcgcctacgcgagaaccacagcgggaacccaaagttcagcttcgtcacgagccagagcgacgcgtacaatccgtactacgagtggcgca<br>aggccgagtacaaggccgggcgtggcacggcgctggcggctggtcgggcggatgcggccgcgttggcggccgccaagctggcagagcaga<br>acaaggagccccagggcccgcccaagccgccgg (400 bp) | IV |

-continued

| | | |
|---|---|---|
| MG07472.4 (nt 603-886) | (SEQ ID NO: 107)<br>ccaatcatctggtttcgagggcggcatcaacgaggacaacccttatgacaagccgctttttgctgttcaggacgccatcagtagtatctaccggccc<br>cgtgcgaacaacgatgatgaggacgaggcggctggcgatgcggagatggccaagatacaaaaggcgagcagatatggtgaggtgctaggc<br>cgaggtacattctccggtgccggggatgtggaagcccgagaaggtccagtgcagttcgaaaaggatgctgcaggcgcggaccctttcaatgtgg<br>aca (284 bp) | PE |
| MG07472.2 (nt 551-940) | (SEQ ID NO: 532)<br>tcgccaagcccacgcagtcgtcagaaggcatgtacgattctcgacttttcaaccaatcatctggtttcgagggcggcatcaacgaggacaaccctt<br>atgacaagccgctttttgctgttcaggacgccatcagtagtatctaccggccccgtgcgaacaacgatgatgaggacgaggcggctggcgatgcg<br>gagatggccaagatacaaaaggcgagcagatatggtgaggtgctaggccgaggtacattctccggtgccggggatgtggaagcccgagaagg<br>tccagtgcagttcgaaaaggatgctgcaggcgcggaccctttcaatgtggacaagttcctgtccgaggtcgaacagaccgcgtcatcaaagagg<br>ggttatggtctgcaagactcgag (400 bp) | * |
| MG06292.4 (nt 1684-1978) | (SEQ ID NO: 108)<br>tatgctgaagcagaggcctccttcaagcgcttaagaacattggcaccgaatcggctggaggacatggaggtctattccacagtactttggcacctg<br>aagaaggaaacagaggcatcgtttctggcacacgagcttgttgacatagcgtggcattcaccgcacgcctggtgcgccttgggcaatgcatggtc<br>gctggcatcagatcgcgaacaagcgctgcggtgcttcaagcgtgctacgcagctcgacgcaaaatttgcatatgcctacacacttcaagggcatg<br>agcactttg (295 bp) | PE |
| MG06292.4 (nt 1601-2000) | (SEQ ID NO: 533)<br>ctttcagcacgataccgcgagctcatgtcgacaccccgtgggttttagctcacatcggacgcgctcagtatgaacagaccaagtatgctgaagcag<br>aggcctccttcaagcgcttaagaacattggcaccgaatcggctggaggacatggaggtctattccacagtactttggcacctgaagaaggaaaca<br>gaggcatcgtttctggcacacgagcttgttgacatagcgtggcattcaccgcacgcctggtgcgccttgggcaatgcatggtcgctggcatcagatc<br>gcgaacaagcgctgcggtgcttcaagcgtgctacgcagctcgacgcaaaatttgcatatgcctacacacttcaagggcatgagcactttgttagtga<br>agaatacgataaggc (400 bp) | IV |
| MG03668.4 (nt 1325-1614) | (SEQ ID NO: 109)<br>cctgctccgaggctattgaccccagccagcacctcgagcctctgatccgctcgttgtttgctggcctgctaaacactcccaagatggccgcctcgtg<br>ctgttgggctctgatgaacctggcggaacgttttgccggtgagcccggagcgccccagaatgccatcactgcctacttcaacgacagtgtgcgca<br>gcctcctggacgtcaccgccaagaacgattgcgactcggctgtcaggacggccgcgtatgaggttctcaacgctttcatcgtcaatgcggcaaac<br>gatt(290 bp) | PE |
| MG03668.4 (1301-1700) | (SEQ ID NO: 534)<br>acgctcttggtcgcatcaccgaggcctgctccgaggctattgaccccagccagcacctcgagcctctgatccgctcgttgtttgctggcctgctaaac<br>actcccaagatggccgcctcgtgctgttgggctctgatgaacctggcggaacgttttgccggtgagcccggagcgccccagaatgccatcactgcc<br>tacttcaacgacagtgtgcgcagcctcctggacgtcaccgccaagaacgattgcgactcggctgtcaggacggccgcgtatgaggttctcaacgct<br>ttcatcgtcaatgcggcaaacgatagtctgcaggctgttgccactctttcggatgttatcatcaagcgcctagaggagacgataccactacagaccc<br>aggttgtcagcgt (400 bp) | IV |
| MG10192.4 (nt 2825-3103) | (SEQ ID NO: 110)<br>gtgacagggtcccatcttcaaacgtcggagccgctccctcggagcgttctgagcgtccctcggagcgccctgctcctgcccgaactggtaccccc<br>atggagcgcactgattcaaacgatcgtgctggtggtccgccccggcttaaccttgctcgtgctgacggtgccaagcccagctggcgtgaacgtga<br>gcaggccaaggctagcggtggccctgagcgggatcttcctcccagcagggcggcttctggaaggggcccaccgatgcacaggaccgatt<br>(279 bp) | PE |
| MG10192.4 (nt 2751-3150) | (SEQ ID NO: 535)<br>tgtcagggcctcggagtctgctggcggcccgccttcgcctcaacttggctggtgcaggtggcaagcccagctggcgtgacagggtcccatcttcaaa<br>cgtcggagccgctccctcggagcgttctgagcgtccctcggagcgccctgctcctgcccgaactggtacccccatggagcgcactgattcaaacg<br>atcgtgctggtggtccgccccggcttaaccttgctcgtgctgacggtgccaagcccagctggcgtgaacgtgagcaggccaaggctagcggtggc<br>cctgagcgggatcttcctcccagcagggcggcttctggaaggggcccaccgatgcacaggaccgattcgggccgtggagagaacggcaggga<br>cgagtcgccggcgccccccaga (400 bp) | IV |

-continued

| | | |
|---|---|---|
| MG00604.4<br>(nt 160-759) | (SEQ ID NO: 111)<br>gcctccggcaacaagcatgttccccgtgctgtcctcgtcgatctcgagcccggcaccatggacgccgtccgtgccggtccttttggccagctcttcc<br>gccccgacaacttcgtcttcggtcagtctggtgctggaaacaactgggccaagggtcactacactgagggtgccgagcttgtcgaccaggtccttg<br>acgtcgtccgtcgtgaggctgagggctgtgactgcctccagggtttccagatcacccactccctgggtggtggtaccggtgccggtatgggtactct<br>gctgatctccaagatccgcgaggagttccccgaccgtatgatggccaccttctcggtcgttccctcgcccaaggtttccgacaccgtcgttgagccct<br>acaacgctaccctctcggtccaccagctggtcgagaactctgacgagaccttctgcattgacaacgaggctctgtacgacatctgcatgcgcacc<br>ctgaagctgtcgaacccctcatacggtgacctgaactacctggtttcggccgtcatgtctggcgtcaccacctgcttgcgtttccccggccagctcaa<br>ctctgatctccgcaagctt (600 bp) | IV |
| MG00604.4<br>(nt 361-950) | (SEQ ID NO: 112)<br>cgtcgtgaggctgagggctgtgactgcctccagggtttccagatcacccactccctgggtggtggtaccggtgccggtatgggtactctgctgatctc<br>caagatccgcgaggagttccccgaccgtatgatggccaccttctcggtcgttccctcgcccaaggtttccgacaccgtcgttgagccctacaacgct<br>accctctcggtccaccagctggtcgagaactctgacgagaccttctgcattgacaacgaggctctgtacgacatctgcatgcgcaccctgaagctg<br>tcgaacccctcatacggtgacctgaactacctggtttcggccgtcatgtctggcgtcaccacctgcttgcgtttccccggccagctcaactctgatctc<br>accgttcccgagttgacccagcagatgttcgaccccaagaacatgatggctgcttctgacttcaggaatggtcgttacctgacctgctctgccatctt<br>(590 bp) | IV |
| MG00604.4<br>(nt 952-1344) | (SEQ ID NO: 113)<br>cgtggaaaggtttccatgaaggaggtcgaggaccagatgcgcaacgtccagaacaagaactcgtcgtacttcgtcgagtggatccccaacaac<br>atccagaccgctctctgctctatcccgccccgcggcctcaagatgtcgtcgactttcatcggaaactcgaccgccatccaggagctgttcaagcgtg<br>tcggtgagcagttcactgccatgttcaggcgcaaggctttcttgcattggtacactggtgagggtatggacgagatggagttcactgaggccgagtc<br>caacatgaacgatcttgtttccgagtaccagcagtaccaggatgctggtgttgacgaggaggaagaggagtacgaggaggaggcccctcttga<br>gggcgaggagtag (393 bp) | IV |
| MG00604.4<br>(nt 160-359) | (SEQ ID NO: 114)<br>gcctccggcaacaagcatgttccccgtgctgtcctcgtcgatctcgagcccggcaccatggacgccgtccgtgccggtccttttggccagctcttcc<br>gccccgacaacttcgtcttcggtcagtctggtgctggaaacaactgggccaagggtcactacactgagggtgccgagcttgtcgaccaggtccttg<br>acgtcgt (200 bp) | IV: 10-50% |
| MG00604.4<br>(nt 760-950) | (SEQ ID NO: 115)<br>gccgtcaacatggttcccttccctcgtctgcacttcttcatggttggcttcgctcctttgaccagccgtggtgcccactctttccgcgctgtcaccgttcccg<br>agttgacccagcagatgttcgaccccaagaacatgatggctgcttctgacttcaggaatggtcgttacctgacctgctctgccatctt (191 bp) | IV: 20-50% |
| MG00604.4<br>(nt 1151-1344) | (SEQ ID NO: 116 and 536)<br>agttcactgccatgttcaggcgcaaggctttcttgcattggtacactggtgagggtatggacgagatggagttcactgaggccgagtccaacatgaa<br>cgatcttgtttccgagtaccagcagtaccaggatgctggtgttgacgaggaggaagaggagtacgaggaggaggcccctcttgagggcgagga<br>gtag (194 bp) | IV: 50-90%<br>see FIG. 1a;<br>PE |
| MG00604.4<br>(3X nt 1151-1344) | (SEQ ID NO: 117)<br>agttcactgccatgttcaggcgcaaggctttcttgcattggtacactggtgagggtatggacgagatggagttcactgaggccgagtccaacatgaa<br>cgatcttgtttccgagtaccagcagtaccaggatgctggtgttgacgaggaggaagaggagtacgaggaggaggcccctcttgagggcgagga<br>gtagagttcactgccatgttcaggcgcaaggctttcttgcattggtacactggtgagggtatggacgagatggagttcactgaggccgagtccaaca<br>tgaacgatcttgtttccgagtaccagcagtaccaggatgctggtgttgacgaggaggaagaggagtacgaggaggaggcccctcttgagggcg<br>aggagtagagttcactgccatgttcaggcgcaaggctttcttgcattggtacactggtgagggtatggacgagatggagttcactgaggccgagtc<br>caacatgaacgatcttgtttccgagtaccagcagtaccaggatgctggtgttgacgaggaggaagaggagtacgaggaggaggcccctcttga<br>gggcgaggagtag (582 bp) | IV |
| MG00604.4 (nt<br>951-1344) | (SEQ ID NO: 537)<br>ccgtggaaaggtttccatgaaggaggtcgaggaccagatgcgcaacgtccagaacaagaactcgtcgtacttcgtcgagtggatccccaacaac<br>atccagaccgctctctgctctatcccgccccgcggcctcaagatgtcgtcgactttcatcggaaactcgaccgccatccaggagctgttcaagcgtgt<br>cggtgagcagttcactgccatgttcaggcgcaaggctttcttgcattggtacactggtgagggtatggacgagatggagttcactgaggccgagtcc<br>aacatgaacgatcttgtttccgagtaccagcagtaccaggatgctggtgttgacgaggaggaagaggagtacgaggaggaggcccctcttgagg<br>gcgaggagtag (394 bp) | IV |

-continued

| | | |
|---|---|---|
| MG00604.4 (nt 745-1344) | (SEQ ID NO: 538)<br>gatctccgcaagcttgccgtcaacatggttcccttccctcgtctgcacttcttcatggttggcttcgctcctttgaccagccgtggtgcccactctttccgc<br>gctgtcaccgttcccgagttgacccagcagatgttcgaccccaagaacatgatggctgcttctgacttcaggaatggtcgttacctgacctgctctgc<br>catcttccgtggaaaggtttccatgaaggaggtcgaggaccagatgcgcaacgtccagaacaagaactcgtcgtacttcgtcgagtggatcccca<br>acaacatccagaccgctctctgctctatcccgccccgcggcctcaagatgtcgtcgactttcatcggaaactcgaccgccatccaggagctgttca<br>agcgtgtcggtgagcagttcactgccatgttcaggcgcaaggctttcttgcattggtacactggtgagggtatggacgagatggagttcactgaggc<br>cgagtccaacatgaacgatcttgtttccgagtaccagcagtaccaggatgctggtgttgacgaggaggaagaggagtacgaggaggaggcccc<br>tcttgagggcgaggagtag (600bp) | IV |
| MG05169.4 (nt 31-330) | (SEQ ID NO: 118)<br>ctcgggaacaaggcagccgcctcagatggcatgccaaatatggtgatgccatatgaacctcaggaccccgctgtcatcgcagagatggtccgc<br>gtgctcgatgagcatacaaagggtggcgccaagggtcgtttccgtatcaagaagaccaagtttgccgttactggttctccttccaaggtcactgtag<br>attcctggaagctacaggactgggactacaagaaacctgggctgcctacatatgcccgtggcctcttcaccacgcgcctcccaaataatgtacca<br>gaaattgccgtcaga (300 bp) | IV |
| MG04056.4 (nt 2377-2676) | (SEQ ID NO: 119)<br>gcaggtgcatcgacggcgcgcgaatcccaggacgttgatcctctaattcacaacccgttcctgaagccgcccgacaaggcagcagtagaaagt<br>accctggttgcgttcgagcccgcgactttcaaattgactttacaaaatccgtatgaaatcgaggttgaaattgaaagcgtgcggttagacacggaag<br>gggtcgagtttgaatcctctgtcgacagcgccctcattggcccatatcgcacgcagatacttcgtctagtcggcataccgaaggctgcggggtctct<br>aaagattaccggc (300 bp) | IV |
| MG08911.4 (nt 2448-2747) | (SEQ ID NO: 120)<br>ggtgatggaatggatgttcaacggccaggttgtagatgccatatttgaaacgatacaccaacagtccagcgatatcggaagcgtttcgcccgattc<br>gcccttgatattgggcattatacgagctgttgaggtggtgtcgaaagttttggagcttcaggacacatatgttgatcttgtgcggcaagtcataaaaca<br>gcacacaggacaacgccatagacatgtgcctcacgcttcctacgcctccttcgaagaagggtttgctcatcacctcgaggtcgtcgcagatctcgg<br>ccgatattg (300 bp) | IV |
| MG06314.4 (nt 551-850) | (SEQ ID NO: 121)<br>ggcggcacgcgctcgaggcaaaacgtatccaggcctcactcaccaagggcgacacacagctttggcttggtactgcagacttggctttgcacat<br>ggtagatggcgcctatcaggattcacccgaggaaatcgacaagactttgaaagtagctatggactgctacaggagcgtattacagatcgacaag<br>acaaaccccgttgctcgcctgggcaaagccgacatcctcgcggacttgggacagtccagcaaggccgttgctgcttatctcgactacctcaaaca<br>gaaaccttataatcttc (300 bp) | IV |
| MG08863.4 (nt 1419-1718) | (SEQ ID NO: 122)<br>cgtggccgacgctgaatttgaaggggagatgagtgtcaaccccacagacttggttacacggccgggtgaaacgcgaacattcaagcccatcat<br>gctggcgcatgggagtcaagcaggtacacgtgatgccttcctcaggttggtttccggtattggctcgccatctcagcaggcagatctggctaccgac<br>atgatcagtctggcaagggatttgtcaggaatagatcaggtcacagccttatggctagcgtttgagttgctgaaagtagcactagccaagaacgag<br>caggacgagcagtt (300 bp) | IV |
| MG07222.4 (nt 161-460) | (SEQ ID NO: 123)<br>ccgctcacacactgcggcccttcaacccgcaaaagcccgccggagcagccatcctcccgatcctcttaccgccagcaacactccgcccattggc<br>cttccggacctttaccaaaaaacacagcctgaccctcacatcgtctgctctacaagagctggcgtcctttgtcggccgacactgcggctcaggatg<br>gcgtgaggaagggctcgccgagcgtgtgctagaggaggtggcaaaatcgtggaaggctggcaatggcggggtgatagtcgatggggccagc<br>cccatcctgaaggacatcc (300 bp) | IV |
| MG01760.4 (nt 1241-1540) | (SEQ ID NO: 124)<br>gtggcggtggcgatgccttaccaagcctggcctcctttgacgttggagcgaatggccaggagatctttgcggattactgcagtgatactatcgacatt<br>cttttgctctcgctggatggcaaagcacggatgatgaatggaaagaagccggttgtcggtgtcttcattgcaaacagtattgccatcaccgagcggt<br>cgattcgcgagtctgatctggcgcctttgatggagacacgcctgggaatattggaaacataccgaaagaaggcgaagctttattacacagagcctt<br>gcaaggatg (300 bp) | IV |

-continued

| | | |
|---|---|---|
| MG07116.4 (nt 959-1258) | (SEQ ID NO: 125)<br>tgatgttgtggaggaagagcaaaagcgatgccgcgagtgacgcgcgcaagcagctgcaaatgtccaaatccgtaccgcccagcggtcctctcc<br>tgaggagaaacacagagccactgcagttgatgtcaggccctaatcctcaagaccagaacggttccatatcgccatcgcctctcgcagcgaagc<br>aggagtatgttgtgcaaacagaaagacggtcaagcgtctccacctatctgctatgccgtgtcctcctcgaggtcatcagccaaagcagtttgagtct<br>gatcactcctgaaatgg (300 bp) | IV |
| MG03872.4 (nt 1125-1424) | (SEQ ID NO: 126)<br>gagcgaagagacctcggaagcggcaaggtttgtcagtggcacgatctacgactcgataggatcacgcctgctcgaaacactcgtaagccattgc<br>ccaggcaagatattcaaaggcctgtggagtcacatcattgggcctcggtttgagacactcctccgtaacgagacggcaacatatgtagcaatgaa<br>ggcattggtcaggctgagtcgagaggacttggcggacgccgtgcttaagacgataccgaaagtggaaatgctagtgtcgaaaggccgcttcaat<br>atcttgacgctgctgtt (300 bp) | IV |
| MG04185.4 (nt 2637-2936) | (SEQ ID NO: 127)<br>actggtgactataggtgacccttcggaaatggtcgtagttctgacacaggccctgcagggtgtcgagatggacgcaaggggttgtcggtcgctcaa<br>catgggcttgcacgttctgagggaagttgtcgatgcgcgccggattttcatccgaccgaatctgaacttgccgccctgagcgggttggccgcgcgc<br>tgccttgaaagccatgagtctggcgtgcggatggatgcagtccaattgtgtgttgccctgcatgcccgtgtgggcgatacacgcttctgggacaaca<br>tcaagggtgt (300 bp) | IV |
| Seastar#2 AFP (nt 162-453) | (SEQ ID NO: 128)<br>cgatatcttgtcaaacgcgttcgcgtacggaaacagagcattgaccaaatacccagacgatatagcagactatttcaagcagtcgtttcccgagg<br>gatattcctgggaaagaagcatgacttttgaagacaaaggcattgtcaccgtggaaactgacgtcagcatggaagacgactgctttatctataaaa<br>ttcgttttgatggggtgaactttcctcccaatggtccagtaatgcagaagaaaactttgaggtgggaaccatccactgagattatgtacgttcgtgatg<br>gc (292bp) | PE |
| Seastar#2 AFP (nt 161-360) | (SEQ ID NO: 129)<br>acgatatcttgtcaaacgcgttcgcgtacggaaacagagcattgaccaaatacccagacgatatagcagactatttcaagcagtcgtttcccgag<br>ggatattcctgggaaagaagcatgacttttgaagacaaaggcattgtcaccgtggaaactgacgtcagcatggaagacgactgctttatctataaa<br>attcgtttt (200 bp) | IV: Taken as 100%, negative control |
| GST (nt 1-200) | (SEQ ID NO: 130)<br>atgtcccctatactaggttattggaaaattaagggccttgtgcaacccactcgacttcttttggaatatcttgaagaaaaatatgaagagcatttgtatg<br>agcgcgatgaaggtgataaatggcgaaacaaaaagtttgaattgggtttggagtttcccaatcttccttattatattgatggtgatgttaaattaacaca<br>(200 bp) | IV: Taken as 100%, negative control |
| GFP | (SEQ ID NO: 131)<br>ttatggtgttcaatgcttttcaagatacccagatcatatgaaacggcatgacttttcaagagtgccatgcccgaaggttatgtacaggaaagaactat<br>atttttcaaagatgacgggaactacaagacacgtaagtttaaacagttcggtactaactaaccatacatatttaaattttcaggtgctgaagtcaagttt<br>gaaggtgatacccttgttaatagaatcgagttaaaaggtattgattttaaagaagatggaaacattcttggacacaaattg (279 bp) | IV: Taken as 100%, negative control |

Table 5B

| Target gene (ID) | Fragment of the target gene | In vitro (IV) or Plant expressed (PE) |
|---|---|---|
| MGG09222.5 (nt 351-750) | (SEQ ID NO: 530)<br>tgactccgagggccacgttggtctgggtatcaagacctccaaggaggttgccactgctatccgcgccgccatcattattgccaagcttagcgtcatcc<br>ccgtccgtcgtggttactggggtaccaaccttggtactcctcactcgctccccgtcaaggagagcggcaagtgcggttccgtcactgtccgccttatcc<br>ctgctccccgtggtaccgccctggttgcctcgcccgctgtcaagcgtctcctccagcttgctggtatcgaggatgcctacacatcgtcgtcaggctcaa<br>ccaagaccctcgagaacaccctgaaggccactttctcggccgtttccaacacatacggtttccttacccccaacctgtggaaggagaccaagctca<br>tcaggagc (400 bp) | IV |

-continued

| | | |
|---|---|---|
| MG00961.4 (nt 701-1100) | (SEQ ID NO: 539)<br>ctgttatgtctgccagcacaacgacactgcgatacccaggctacatgcacaatgacctcgtcagcatattggcgtccttgatccctacgcccaaatg<br>ccacttcttgatgacatcatatactccttttacgggagatcaagtcgagcaggcaaagacggtgcgcaagacgacagttttggatgtcatgcgcagg<br>ttactgcagcccaagaaccgcatggtttcaacgatacccgggaagaagagttgttacatttcaattctcaatgtgattcaaggcgaagttgatccaac<br>cgatgttcacaagtctttgctgcgcattcgtgaaaggaggttggcaacttttattccttggggaccggcgagtatccaggttgctttgaccaaaaggag<br>cccatacat (400 bp) | IV |
| MG00961.4 (nt 1062-1461) | (SEQ ID NO: 540)<br>gagtatccaggttgctttgaccaaaaggagcccatacataccaatgagccaccgtgtcagcggtctcatgttagccaaccacaccagcattgcta<br>cagtaaggaacacttttgttgtatttttgatcacagaattcatactgaccaagtgcgcccttaatgttctgcagcttttcaaaaggatcgtaaggcaatac<br>gacgggatgcgcaagcgcaacgcattcatagaaggctacaagaagacacagccattctcggaaaaccttgatgagtttgacgaagcgcggca<br>agtggtcagcgaccttatcgcagagtacgaagctgccgaagatgccaactatttaaacccggatgccggtgagcctggcacctcggccgagac<br>ggatcggagaatggggtga (400 bp) | * |
| MGG02952.5 (nt 598-1024) | (SEQ ID NO: 541)<br>gtctcaagaacaagcgtgaggtctggcgtgtccagctcactctgtccaagattcgtcgtgctgcccgtcagcttcttaccctcgacgagaaggaccc<br>caagcgcctgttcgagggtaacgccttgattcgccgtctggtgcgtgtcggtgttcttgacgagtcgcgcatgaagctcgattacgttcttgccctcaag<br>gtcgaggacttcctggagcgccgtctccagacctgcgtctacaagcttggtctcgccaagtccatccaccacgcccgtgtcctcattcgccagcgcc<br>acatccgcgtcggcaagcagatcgtcaacgtcccctcgttcgtcgtccgtctcgactcccagaagcacatcgacttcgcccttacctcgccatttggc<br>ggtggccgtcccggccgtgtccgcagaaagaaggc (427 bp) | * |
| MGG04095.5 (nt 569-971) | (SEQ ID NO: 542)<br>catcttggggctgcgatcacaactcgacatgcttcagaagcgtgaaaagcacctgcaaaatcagatttccgaacaggatgcgatcgcgaggaag<br>aacatttcaacaaacaagaatgccgccaaggccgcgttgaagaggaagaagacacatgagcacagtcttgaccaaacgctctcgcagatcgg<br>caccccttgagcagcagataaacgctatcgagtctgcaaacatcaacatggaaaccctcgaggccatgaagaaggcaggcaaggccatggag<br>gacatacacggaaagcttacggtagagaaggtcgatgagaccatggacaagttacgggagcagaatgctctcagcgaggagattgtcaacgc<br>catcacaaacaatcagctcggaaacgaggcaatc (403 bp) | IV |
| contig2.561.g35 | (SEQ ID NO: 543)<br>gcaaggtccgcaccgactcgacttaccccgccggcttcatggacgttgtttcgatcgagaagactggcgagaacttccgtctcgtctacgacacca<br>agggacgcttcaccgtccaccgcatccaggccgaggaggccgagtacaagctcggcaaggtcaagcgtgttcagctcggccgcggcgggatc<br>ccattcttggttacgcatgatgccagaaccatccgctaccccgaccctctgatcaaggtcaacgacactgtcaagatcaaccttgacactggcaag<br>atcaccgacttcatcaagttcgacactggcgccctcgccatggttaccgctggtaacaacatgggtcgtgttggtgttatcacccaccgtgagcgcca<br>cgatggtggcttcaacattgtgc (405 bp) | IV |
| contig2.887.g4 | (SEQ ID NO: 544)<br>cctcttgcgtgagcatggataccaatctcgaggctttgaggttctctatcacggccacactggtcggaagctgagagctcaagtcttctttggaccgac<br>atactaccagcgtctgaggcacatggtggacgataagattcacgcccgagcacgtggtcccgtcaacatcatgacaagacagccagtggagggt<br>cgtgcgcgtgatggtggtctgcgtttcggagaaatggaacgtgattgcatgattgcacacggagcagcctccttcttgaaggagaggttgtttgaggtt<br>tcggatgcgttcagggcgcatatctgtggtatttgtgggctgatgacgcccattgccgatctcaccaggaaaacattcgagtgtcggccatgtaggaa<br>caagaccaagatcg (404 bp) | * |
| MGG05193.5 (nt 2028-2426) | (SEQ ID NO: 545)<br>ggagcaggtccagtacccagtcgaccaccccgagaagttcctcaagttcggtctctcaccatcgcgtggcgtgcttttctacggtcccccgggtacc<br>ggaaagaccatgttggccaaggccgttgccaacgagtgtgcagcaaactttatctccgtcaagggtccagagctgctcagcatgtggtttggagag<br>tcggaaagcaacattcgtgatatcttcgacaaagcgcgcgctgcggcaccttgcattgttttccttgacgagcttgactcaatcgccaaggctcgtgg<br>aggctcggtgggtgacgccggcggtgcatcggaccgtgttgtaaaccagctgctgacggagatggacggtatgacttccaagaagaacgtgttcg<br>ttattggagcgacc (400 bp) | IV |

-continued

| | | |
|---|---|---|
| MGG09952.5 (nt745-1143) | (SEQ ID NO: 546)<br>gccagtgcggtatcatcatgtttgacgtcacatcccgcatcacctacaagaacgtccccaactggcaccgtgacttggttcgtgtgtgcgagaacatc<br>cctattgttctctgcggtaacaaggtcgacgtcaaggagcgcaaggtgaaggccaagaccatcaccttccacaggaagaagaacctgcagtatt<br>acgacatctcggccaagtcgaactacaacttcgagaagcctttcctgtggctcggccgcaagcttgttggcaaccccggtctggaattcgttgccgc<br>ccccgcccttgctccccccaccgccgaggtgaccgcagagcaggcggccgcgtacgagaaagaccttgcagatgctacgcgtgcgcccctgcc<br>cgatgatgatgatgaag (399 bp) | IV |
| MGG06910.5 (nt 1569-1977) | (SEQ ID NO: 547)<br>caggtcggtcttctggagatgaaaggtctcagcaactccacaggtggtcatatgattttggtcgatagctttacgtcgtccatgttcaagcagtcgttcgt<br>gagggtattcgaaaaggatggagacgacaacctgctcatgggtttcaacggtatcttggaggtcctgaccaccaaggagctcaaggttacaggtct<br>gattggtcacgccgtctcgatgaacaagaagtcgacctctgtcggtgagaccgagtgcggtattggcaacacgtgctcgtggaagatgtgcggtatt<br>gacccaacatcaagctacggcatctacttcgaggttgcacaaggtggcccgtcacacgcccaaccagctcagaaagggatgatgcaatttctcac<br>atattaccagcactcatctg (409 bp) | * |
| contig2.1499.g3 | (SEQ ID NO: 548)<br>cctgtgactacatcgaccctgtccattgtccaggtcttctggggtctcgacaagaaactggcacagcgcaagcacttcccgtccatcaacacttccctt<br>tcgtacagcaagtacacgatgatattggagaagtggtacgagaaggagcaccccgacttcccacgtctgcgtgaccaggtcaggcagctgctgtc<br>agactcggaggagctggaccaggtcgtgcagcttgtcggcaagtcggcgctttcggaccccgacaagatcacacttgacatggccacgctgctc<br>aaggaggactttttgcagcagaacggctacagtgactacgaccagttctgtcccatctggaagacagagtggatgatgcgcctgatgatgggtttcc<br>acgacgaggc (395 bp) | IV |
| MGG04829.5 (nt 653-1052) | (SEQ ID NO: 549)<br>cgttatcggcatcgagattcaccacggcaagcgcaaggatgtcgccaccctccgtaccgtccgcaccctgatcaacaacttgatcattggtgtcacc<br>aagggctacaagtacaagatgcgttacgtctacgcccatttccccatcaacgtcaacgttgagaagaacaacgagactggcaacgccgaggtcg<br>agatccgaaacttcatcggcgagaagctcgtccgcagggtcgccatgcagcctggtgttgaggttgagatctcaaaggcccagaaggatgagct<br>catcctgtccggtaactctgtcgaggctgtctcgcaaagcgccgccgatatccagcagatctgcaaagtacggaacaaggatatccgtaagttcttg<br>gatggtatgtacgtctcg (400 bp) | IV |
| MG5858.4 (nt 171-570) | (SEQ ID NO: 550)<br>cgagtttgtcgatgacttcacagtacgcgtcgttgatgtttttgccatgccacaaagcggtactggagtcagtgtcgaggcagtcgacccggtgttcca<br>gatgaagatgatggatatgttgcggcaaacaggaaggcccgagtccgtcgtgggctggtaccactcacatcccggtttcggctgctggttgtcgtcg<br>gtggatatcaacactcagcagagtttcgagcagctcacaccacgtgccgtcgctgtggtcgttgacccgattcagtccgtcaaaggaaaggttgtca<br>tagacgctttccgtctcatcaacccgcaatctctcatgctcggacaggagccccgccaaagcacatccaaccttggccacctcaacaaaccctcga<br>ttcaagcattg (400 bp) | * |
| contig2.1053.g5 | (SEQ ID NO: 551)<br>cgtccgttttggactgtggcaagaacaagatctggctggaccccaacgaggtgtccgagatctccaacgccaactcccgccagaccatccgcaa<br>gcttgtccaggatggcctgatcatcaagaagccagtcaccatgcactcaagagcacgcgctcgggagcttaacctcgcccgacggatcggccgg<br>caccgtggtttcggaaagcgcaagggtaccgcagatgcccgtatgccgactcaggtcgtctggatgcgccgccagcgggttctccgtcggttgctc<br>gtcaagtaccgcgccagcggcaagatcgacaagcacctttaccacgagctttaccactccgccaagggtaacaccttcaagcacaagcgtgcg<br>cttgttgagcacatccaccgtgc (400 bp) | IV |
| contig2.875.g14 | (SEQ ID NO: 552)<br>ggtggtcctcgcagcttcaatctgcactcgcggcggcaaggctgtcctgtcgaggcagttccgcgagatgccccggtcgaggatagaagctttgct<br>cgcctcgttcccaaagcttgccgacagtggtacccagcacacgaccgttgagcaggacaatgttcgattcgtctaccagcccctcgacgagctcta<br>catggttctcatcacgaaccgtcagtccaacatccttcaggatatcgactccctgcaccttttcgcacaggttgtgaccagcacttgcaagagcttgga<br>cgagcgggagattctcaagaatgcctacgaactccttagcgcctttgacgagctggttactctgggctacagggagaacttgaccattagccagatc<br>aagaccttcctc (400 bp) | * |

-continued

| | | |
|---|---|---|
| Seastar AFP (nt 51-450) | (SEQ ID NO: 553)<br>tgtaaacgggcatgcttttgtgattgaaggaaaaggagaaggaaagcctttcgatgggacacacactttaaacctggaagtgaaagaaggtgca<br>cctctgcctttttcctacgatatcttgtcaaacgcgttcgcgtacggaaacagagcattgaccaaatacccagacgatatagcagactatttcaagca<br>gtcgtttcccgagggatattcctgggaaagaagcatgacttttgaagacaaaggcattgtcaccgtggaaactgacgtcagcatggaagacgact<br>gctttatctataaaattcgttttgatggggtgaactttcctcccaatggtccagtaatgcagaagaaaactttgaggtgggaaccatccactgagattat<br>gtacgttcgtgat (400 bp) | IV |
| GST (nt 241-640) | (SEQ ID NO: 554)<br>atgtcccctatactaggttattggaaaattaagggccttgtgcaacccactcgacttcttttggaatatcttgaagaaaaatatgaagagcatttgtatga<br>gcgcgatgaaggtgataaatggcgaaacaaaaagtttgaattgggtttggagtttcccaatcttccttattatattgatggtgatgttaaattaacacagt<br>ctatggccatcatacgttatatagctgacaagcacaacatgttgggtggttgtccaaaagagcgtgcagagatttcaatgcttgaaggagcggttttg<br>gatattagatacggtgtttcgagaattgcatatagtaaagactttgaaactctcaaagttgattttcttagcaagctacctgaaatgctgaaaatgttcg<br>(400 bp) | IV |
| GFP (nt 1-400) | (SEQ ID NO: 555)<br>atgacttttcaagagtgccatgcccgaaggttatgtacaggaaagaactatatttttcaaagatgacgggaactacaagacacgtgctgaagtcaa<br>gtttgaaggtgatacccttgttaatagaatcgagttaaaaggtattgattttaaagaagatggaaacattcttggacacaaattggaatacaactataa<br>ctcacacaatgtatacatcatggcagacaaacaaaagaatggaatcaaagttaacttcaaaattagacacaacattgaagatggaagcgttcaa<br>ctagcagaccattatcaacaaaatactccaattggcgatggccctgtccttttaccagacaaccattacctgtccacacaatctgccctttcgaaagat<br>cccaacgaaaa (400 bp) | IV |

TABLE 6

| Target gene M. grisea identifier | primer name | primer sequence | sense (S)/ antisense (AS) | Restriction enzyme |
|---|---|---|---|---|
| MG00170.4 | oBG109 (SEQ ID NO: 132) | GAATTCATGGACACCCTGGTAGCC | S | EcoRI |
| | oBG110 (SEQ ID NO: 133) | CTGCAGCGTTGGTAAACTCGCCCT | S | PstI |
| | oBG107 (SEQ ID NO: 134) | CCCGGGATGGACACCCTGGTAGCC | AS | XmaI |
| | oBG108 (SEQ ID NO: 135) | AGATCTCGTTGGTAAACTCGCCCT | AS | BglII |
| MG00884.4 | oBG33 (SEQ ID NO: 136) | GAATTCCGACCTGCTCGTCTCACATA | S | EcoRI |
| | oBG34 (SEQ ID NO: 137) | CTGCAGAGGAAGTAAGGGTGCAGTGC | S | PstI |
| | oBG35 (SEQ ID NO: 138) | CCCGGGCGACCTGCTCGTCTCACATA | AS | XmaI |
| | oBG36 (SEQ ID NO: 139) | CCATGGAGGAAGTAAGGGTGCAGTGC | AS | NcoI |
| MG07031.4 | oBG37 (SEQ ID NO: 140) | GAATTCGGAGTACATCATGGCAAACG | S | EcoRI |
| | oBG38 (SEQ ID NO: 141) | CTGCAGATCGGGATGGTGATGTTTG | S | PstI |
| | oBG39 (SEQ ID NO: 142) | CCCGGGGGAGTACATCATGGCAAACG | AS | XmaI |
| | oBG40 (SEQ ID NO: 143) | CCATGGATCGGGATGGTGATGTTTG | AS | NcoI |
| MG04484.4 | oBG087 (SEQ ID NO: 144) | GAATTCATGGGTATCGATCTTAAGAAGCACCACG | S | EcoRI |
| | oBG088 (SEQ ID NO: 145) | CTGCAGTTAGACCTTGAAACCACGCGATCGTCT | S | PstI |
| | oBG089 (SEQ ID NO: 146) | CCCGGGATGGGTATCGATCTTAAGAAGCACCACG | AS | XmaI |
| | oBG090 (SEQ ID NO: 147) | CCATGGTTAGACCTTGAAACCACGCGATCGTCT | AS | NcoI |
| MG02946.4 | oBG49 (SEQ ID NO: 148) | GAATTCACTGCGGCCGCGGCACAG | S | EcoRI |
| | oBG50 (SEQ ID NO: 149) | CTGCAGCGCATCCGCCCGACCAGC | S | PstI |
| | oBG51 (SEQ ID NO: 150) | CCCGGGACTGCGGCCGCGGCACAG | AS | XmaI |
| | oBG52 (SEQ ID NO: 151) | CCATGGCGCATCCGCCCGACCAGC | AS | NcoI |
| MG07472.4 | oBG53 (SEQ ID NO: 152) | GAATTCCCAATCATCTGGTTTCGAGG | S | EcoRI |
| | oBG54 (SEQ ID NO: 153) | ACGCGTTGTCCACATTGAAAGGGTCC | S | MluI |
| | oBG55 (SEQ ID NO: 154) | CCCGGGCCAATCATCTGGTTTCGAGG | AS | XmaI |
| | oBG56 (SEQ ID NO: 155) | CCATGGTGTCCACATTGAAAGGGTCC | AS | NcoI |
| MG06292.4 | oBG57 (SEQ ID NO: 156) | GAATTCTATGCTGAAGCAGAGGCCTC | S | EcoRI |
| | oBG58 (SEQ ID NO: 157) | CTGCAGCAAAGTGCTCATGCCCTTG | S | PstI |
| | oBG59 (SEQ ID NO: 158) | CCCGGGTATGCTGAAGCAGAGGCCTC | AS | XmaI |
| | oBG60 (SEQ ID NO: 159) | CCATGGCAAAGTGCTCATGCCCTTG | AS | NcoI |
| MG03668.4 | oBG61 (SEQ ID NO: 160) | GAATTCCCTGCTCCGAGGCTATTG | S | EcoRI |
| | oBG62 (SEQ ID NO: 161) | CTGCAGATCGTTTGCCGCATTGAC | S | PstI |
| | oBG63 (SEQ ID NO: 162) | CCCGGGCCTGCTCCGAGGCTATTG | AS | XmaI |
| | oBG64 (SEQ ID NO: 163) | CCATGGATCGTTTGCCGCATTGAC | AS | NcoI |
| MG10192.4 | oBG65 (SEQ ID NO: 164) | GAATTCGTGACAGGGTCCCATCTTCA | S | EcoRI |
| | oBG66 (SEQ ID NO: 165) | CTGCAGAATCGGTCCTGTGCATCG | S | PstI |
| | oBG67 (SEQ ID NO: 166) | CCCGGGGTGACAGGGTCCCATCTTCA | AS | XmaI |
| | oBG68 (SEQ ID NO: 167) | AGATCTAATCGGTCCTGTGCATCG | AS | BglII |
| MG00604.4 (11.1) | oBG093 (SEQ ID NO: 168) | GAATTCGCCTCCGGCAACAAGCATGTTC | S | EcoRI |
| | oBG094 (SEQ ID NO: 169) | CTGCAGAAGCTTGCGGAGATCAGAGTTGAGCTGG | S | PstI |
| | oBG091 (SEQ ID NO: 170) | CCCGGGGCCTCCGGCAACAAGCATGTTC | AS | XmaI |
| | oBG092 (SEQ ID NO: 171) | AGATCTAAGCTTGCGGAGATCAGAGTTGAGCTGG | AS | BglII |
| MG00604.4 (11.2) | oBG097 (SEQ ID NO: 172) | GAATTCCCGTCGTGAGGCTGAGGGCTGTG | S | EcoRI |
| | oBG098 (SEQ ID NO: 173) | CTGCAGAAGATGGCAGAGCAGGTCAGGTAACGA | S | PstI |
| | oBG095 (SEQ ID NO: 174) | CCCGGGCCGTCGTGAGGCTGAGGGCTGTG | AS | XmaI |
| | oBG096 (SEQ ID NO: 175) | CCATGGAAGATGGCAGAGCAGGTCAGGTAACGA | AS | NcoI |
| MG00604.4 (11.3) | oBG101 (SEQ ID NO: 176) | GAATTCCCGTGGAAAGGTTTCCATGAAGGAGG | S | EcoRI |
| | oBG102 (SEQ ID NO: 177) | CTGCAGCTACTCCTCGCCCTCAAGAGGG | S | PstI |
| | oBG099 (SEQ ID NO: 178) | CCCGGGCCGTGGAAAGGTTTCCATGAAGGAGG | AS | XmaI |
| | oBG100 (SEQ ID NO: 179) | CCATGGCTACTCCTCGCCCTCAAGAGGG | AS | NcoI |
| MG00604.4 (11.4) | oBG105 (SEQ ID NO: 180) | GAATTCAGTTCACTGCCATGTTCAG | S | EcoRI |
| | oBG106 (SEQ ID NO: 181) | CTGCAGCTACTCCTCGCCCTCAAG | S | PstI |
| | oBG103 (SEQ ID NO: 182) | CCCGGGAGTTCACTGCCATGTTCAG | AS | XmaI |
| | oBG104 (SEQ ID NO: 183) | CCATGGCTACTCCTCGCCCTCAAG | AS | NcoI |

TABLE 7

| | Sporulation | |
|---|---|---|
| | 1 μM | 2 μM |
| MG02946.4 | + | – |
| MG03668.4 | + | – |
| MG00604.4 | +/– | – |
| Seastar | +++ | +++ |
| GST | +++ | +++ |

TABLE 8

| Target ID | SEQ ID No | Sequence* | Example Gi-number and species |
|---|---|---|---|
| MG00170.4 | 562 | GCAGACTGCCAGTACTGGCTCGCCTGGCT | 14663286 (*Fusarium sporotrichioides*) |
| | 563 | TACAAGGGCATGGGCCTCAGCATGG | 14663286 (*Fusarium sporotrichioides*) |
| MG07031.4 | 564 | CTTTTTTTTTTTTTTTTGCTG | 58096826 (*Phytophthora infestans*) |
| | 565 | GAGACTTTTTTTTTTTTTTTT | 60673784 (*Alternaria brassicicola*) |
| | 566 | GCTCTGAATCGTCGTCCGAGC | 67522041 (*Aspergillus nidulans* FGSC A4) |
| | 567 | TACTACTGCCTCTCCATCCTCGACAA | 48689269 (*Gibberella zeae*) |
| | 568 | TGAAGAGGAGATTACCGATTG | 58264247 (*Cryptococcus neoformans* var.) |
| | 569 | TTTTTTTTTTTTTTTTGCTGCGG | 58102240 (*Phytophthora infestans*) |
| MG04484.4 | 570 | ACCGACTCCAGCTTCAACAAGGTTGTCCT | 46347545 (*Paracoccidioides brasiliensis*) |
| | 571 | AGAGCGACAATGTCTACCTCAAGCTCTTGGTGAAGCTCTACC GCTTCCTGGCCCGC | 70711195 (*Gibberella moniliformis*) |
| | 572 | CAACCGCCCTCCCGTCTCCCTGTC | 70711195 (*Gibberella moniliformis*) |
| | 573 | CGGCACCGTCACCGACGACAAC | 70816217 (*Aspergillus niger*) |
| | 574 | GCCCCCAAGAGCGACAATGTCTACCTCAAGCTCTTGGTGAAGCT CTACCGCTTCCTGGC | 22509454 (*Gibberella zeae*) |
| | 575 | TTCACCGCCACCGCCCGTGCCCGCATC | 22509454 (*Gibberella zeae*) |
| MGG09222.5 | 576 | ACCAAGACCCTCGAGAACACCCTGAAGGCCAC | 29427674 (*Verticillium dahliae*) |
| | 577 | AGCGTCATCCCCGTCCGTCGTGGTTACTGGGGTACCAACCTTG GT | 22503034 (*Gibberella zeae*) |
| | 578 | CCCAACCTGTGGAAGGAGACCAAGCTCATC | 29427674 (*Verticillium dahliae*) |
| | 579 | CCCGCTGTCAAGCGTCTCCTCCAGCTTGC | 70982515 (*Aspergillus fumigatus*) |
| | 580 | GGTATCAAGACCTCCAAGGAGGTTGCCAC | 31371647 (*Gibberella zeae*) |
| | 581 | TTCCTTACCCCCAACCTGTGGAAGGAGACCAAGCTCATCAGGAG | 21906277 (*Colletotrichum trifolii*) |
| MG00604.4 | 582 | CAGAACAAGAACTCGTCGTACTTCGTCGAGTGGATCCCCAACAA CATC | 68417116 (*Phytophthora parasitica*) |
| | 583 | CAGTTCACTGCCATGTTCAGGCGCAAGGCTTTCTTGCATTGGT ACACTGGTGAGGGTATGGACGAGATGGAGTTCACTGAGGC | 66909865 (*Phaeosphaeria nodorum*) |
| | 584 | CCATCCAGGAGCTGTTCAAGCGTGTCGGTGA | 70825342 (*Aspergillus niger*) |
| | 585 | CCCAACAACATCCAGACCGCTCTCTGCTC | 67518028 (*Aspergillus nidulans* FGSC A4) |
| | 586 | CCGTTCCCGAGTTGACCCAGCAGATGTTCGACCCCAAGAACATG ATGGCTGC | 67518028 (*Aspergillus nidulans* FGSC A4) |
| | 587 | GAGATGGAGTTCACTGAGGCCGAGTCCAACATGAACGATCTTGT | 46136028 (*Gibberella zeae* PH-1) |
| | 588 | GAGGAGGAAGAGGAGTACGAGGAGGAG | 70713442 (*Gibberella moniliformis*) |
| | 589 | GAGGGTATGGACGAGATGGAGTTCACTGAGGCCGAG | 70995399 (*Aspergillus fumigatus*) |
| | 590 | GAGTACCAGCAGTACCAGGATGC | 68417116 (*Phytophthora parasitica*) |
| | 591 | GAGTTGACCCAGCAGATGTTCGACCCCAAGAACATGATGGCTGC TTC | 70995399 (*Aspergillus fumigatus*) |
| | 592 | GCCGTCAACATGGTTCCCTTCCCTCGTCTGCACTTCTTCATGGT | 70995399 (*Aspergillus fumigatus*) |
| | 593 | GGTCGTTACCTGACCTGCTCTGCCATCTTCCGTGG | 46136028 (*Gibberella zeae* PH-1) |
| | 594 | GGTGAGCAGTTCACTGCCATGTTC | 70713442 (*Gibberella moniliformis*) |
| | 595 | GTCAACATGGTTCCCTTCCCTCGTCTGCACTTCTTCATGGTTGG | 49079639 (*Ustilago maydis*) |
| | 596 | TACCAGCAGTACCAGGATGCTGGT | 70713442 (*Gibberella moniliformis*) |
| | 597 | TACTTCGTCGAGTGGATCCCCAACAACATCCAGACCGC | 70825342 (*Aspergillus niger*) |
| | 598 | TCCATGAAGGAGGTCGAGGACCAGATGCGCAACGTCCAGAACAA GAACTCGTC | 66909865 (*Phaeosphaeria nodorum*) |
| | 599 | TCCGAGTACCAGCAGTACCAGGA | 67518028 (*Aspergillus nidulans* FGSC A4) |
| MGG02952.5 | 600 | AACAAGCGTGAGGTCTGGCGTGTCCAGCTCAC | 29426916 (*Verticillium dahliae*) |
| | 601 | AAGTCCATCCACCACGCCCGTGTCCTCAT | 21907821 (*Colletotrichum trifolii*) |
| | 602 | CAAGCTTGGTCTCGCCAAGTCC | 33513606 (*Cryptococcus neoformans* var.) |
| | 603 | CAGAAGCACATCGACTTCGCCCTTACCTCGCCATT | 47031693 (*Mycosphaerella graminicola*) |
| | 604 | CAGACCTGCGTCTACAAGCTTGG | 2844032 (*Emericella nidulans*) |
| | 605 | CGCATGAAGCTCGATTACGTT | 5826473 (*Botryotinia fuckeliana*) |
| | 606 | CGCCAGCGCCACATCCGCGTCGGCAAGCAGATCGTCAACGT | 21907821 (*Colletotrichum trifolii*) |
| | 607 | CGTCGTGCTGCCCGTCAGCTTCTTACCCTCGACGAGAAGGACCC CAAGCG | 70734819 (*Gibberella moniliformis*) |
| | 608 | CTCATTCGCCAGCGCCACATCCGCGTCGGCAAGCAGATCGT | 29426916 (*Verticillium dahliae*) |
| | 609 | CTCGCCAAGTCCATCCACCACGCCCGTGT | 29426916 (*Verticillium dahliae*) |
| | 610 | GACGAGAAGGACCCCAAGCGCCT | 21907821 (*Colletotrichum trifolii*) |

TABLE 8-continued

| Target ID | SEQ ID No | Sequence* | Example Gi-number and species |
|---|---|---|---|
| | 611 | GACTCCCAGAAGCACATCGACTTCGCCCT | 70823211 (*Aspergillus niger*) |
| | 612 | GAGAAGGACCCCAAGCGCCTGTTCGAGGGTAACGCC | 34332427 (*Ustilago maydis*) |
| | 613 | GCCAAGTCCATCCACCACGCCCGTGTCCT | 2844032 (*Emericella nidulans*) |
| | 614 | GGCGGTGGCCGTCCCGGCCGTGTCCGCAGAAAGAAGG | 70694169 (*Gibberella moniliformis*) |
| | 615 | GTCGGCAAGCAGATCGTCAACGTCCCCTC | 70823211 (*Aspergillus niger*) |
| | 616 | TCCAAGATTCGTCGTGCTGCCCGTCAGCT | 21907821 (*Colletotrichum trifolii*) |
| | 617 | TCGTCCGTCTCGACTCCCAGAAGCACATCGACTTCGC | 70694169 (*Gibberella moniliformis*) |
| MGG04095.5 | 618 | AACATGGGTCGTGTTGGTGTTATCAC | 70678182 (*Gibberella moniliformis*) |
| | 619 | AACTTCCGTCTCGTCTACGACACCAAGGG | 46343134 (*Paracoccidioides brasiliensis*) |
| | 620 | ACCCACCGTGAGCGCCACGATGGTGG | 70823112 (*Aspergillus niger*) |
| | 621 | AGAACCATCCGCTACCCCGACCCT | 48901692 (*Aspergillus flavus*) |
| | 622 | ATCCCATTCTTGGTTACGCATGA | 47032032 (*Mycosphaerella graminicola*) |
| | 623 | ATCGAGAAGACTGGCGAGAACTTCCGTCTC | 49094939 (*Aspergillus nidulans* FGSC A4) |
| | 624 | ATGGAACGTGATTGCATGATTGC | 34331251 (*Ustilago maydis*) |
| | 625 | CAACATGGGTCGTGTTGGTGT | 46128672 (*Gibberella zeae* PH-1) |
| | 626 | CACTGGCAAGATCACCGACTTCATCAAGTTCGACAC | 46128672 (*Gibberella zeae* PH-1) |
| | 627 | CCCCGCCGGCTTCATGGACGT | 45244151 (*Phytophthora nicotianae*) |
| | 628 | CGAGGAGGCCGAGTACAAGCT | 46128672 (*Gibberella zeae* PH-1) |
| | 629 | CGCCACGATGGTGGCTTCAACATTGT | 24455690 (*Paracoccidioides brasiliensis*) |
| | 630 | CGCTTCACCGTCCACCGCATCCAGGC | 70823112 (*Aspergillus niger*) |
| | 631 | GACTTCATCAAGTTCGACACTGG | 70678182 (*Gibberella moniliformis*) |
| | 632 | GAGAAATGGAACGTGATTGCA | 58118641 (*Phytophthora infestans*) |
| | 633 | GAGAAGACTGGCGAGAACTTCCGTCTCGTCTACGA | 46128672 (*Gibberella zeae* PH-1) |
| | 634 | GAGGAGGCCGAGTACAAGCTC | 70823112 (*Aspergillus niger*) |
| | 635 | GAGGAGGCCGAGTACAAGCTCGGCAAGGTCAAGCGTGT | 29426157 (*Verticillium dahliae*) |
| | 636 | GCAAGGTCAAGCGTGTTCAGCTCGGC | 70823112 (*Aspergillus niger*) |
| | 637 | GCAAGGTCCGCACCGACTCGAC | 60673542 (*Alternaria brassicicola*) |
| | 638 | GGCGGGATCCCATTCTTGGTTACGCA | 70823112 (*Aspergillus niger*) |
| | 639 | TACCCCGACCCTCTGATCAAGGTCAACGACACTGTCAAGAT | 46128672 (*Gibberella zeae* PH-1) |
| | 640 | TTCGGAGAAATGGAACGTGATTG | 70710347 (*Gibberella moniliformis*) |
| MGG05193.5 | 641 | AGCAAACTTTATCTCCGTCAAGGG | 41543841 (*Cryptococcus neoformans* var.) |
| | 642 | AGCAACATTCGTGATATCTTCGACAA | 25129989 (*Paracoccidioides brasiliensis*) |
| | 643 | ATGTTGGCCAAGGCCGTTGCCAACGAGTGTGC | 70683086 (*Gibberella moniliformis*) |
| | 644 | CTCAGCATGTGGTTTGGAGAGTC | 47029850 (*Mycosphaerella graminicola*) |
| | 645 | GAGAAGTTCCTCAAGTTCGGTCT | 47029546 (*Mycosphaerella graminicola*) |
| | 646 | GAGATGGACGGTATGACTTCCAAGAAGAACGT | 46122304 (*Gibberella zeae* PH-1) |
| | 647 | GTCGACCACCCCGAGAAGTTCC | 70823844 (*Aspergillus niger*) |
| MGG09952.5 | 648 | AACAAGGTCGACGTCAAGGAGCG | 24447584 (*Paracoccidioides brasiliensis*) |
| | 649 | AACTACAACTTCGAGAAGCCTTTCCTGTGGCTCG | 70767614 (*Gibberella moniliformis*) |
| | 650 | AAGTCGAACTACAACTTCGAGAAGCC | 48899092 (*Aspergillus flavus*) |
| | 651 | ACCTACAAGAACGTCCCCAACTGGCACCGTGA | 70699127 (*Gibberella moniliformis*) |
| | 652 | ATCACCTACAAGAACGTCCCCAACTGGCACCGTGA | 48884377 (*Aspergillus flavus*) |
| | 653 | ATCACCTACAAGAACGTCCCCAACTGGCACCGTGA | 10181839 (*Aspergillus niger*) |
| | 654 | ATTGTTCTCTGCGGTAACAAGGTCGA | 22506497 (*Gibberella zeae*) |
| | 655 | GCCAGTGCGGTATCATCATGTT | 48899092 (*Aspergillus flavus*) |
| | 656 | TACAAGAACGTCCCCAACTGGCACCGTGAC | 70992714 (*Aspergillus fumigatus*) |
| MGG06910.5 | 657 | ATCTGGAAGACAGAGTGGATGATG | 70756653 (*Gibberella moniliformis*) |
| | 658 | CACTTCCCGTCCATCAACACTTC | 46343356 (*Paracoccidioides brasiliensis*) |
| | 659 | CAGCGCAAGCACTTCCCGTCC | 9834135 (*Phytophthora sojae*) |
| | 660 | CAGGTCTTCTGGGGTCTCGACAAGAA | 70756653 (*Gibberella moniliformis*) |
| | 661 | TTCTGGGGTCTCGACAAGAAA | 71004203 (*Ustilago maydis*) |
| MGG04829.5 | 662 | AACAAGGATATCCGTAAGTTCTTGGATGGTAT | 50286950 (*Candida glabrata* CBS 138) |
| | 663 | AGCGCCGCCGATATCCAGCAGATCTGC | 34332067 (*Ustilago maydis*) |
| | 664 | CAAGTACAAGATGCGTTACGTCTACGCCCATTTCCCCATCAACGTCAAC | 29426217 (*Verticillium dahliae*) |
| | 665 | CCCAGAAGGATGAGCTCATCCTG | 70700474 (*Gibberella moniliformis*) |
| | 666 | GAGATCCGAAACTTCATCGGCGAGAAGCTCGT | 70702890 (*Gibberella moniliformis*) |
| | 667 | TACGTCTACGCCCATTTCCCCATCAACGTCAACGT | 70702890 (*Gibberella moniliformis*) |
| | 668 | TGATCATTGGTGTCACCAAGGGCT | 70690968 (*Gibberella moniliformis*) |
| MG5858.4 | 669 | TTTGCCATGCCACAAAGCGGTAC | 70712617 (*Gibberella moniliformis*) |
| contig2.1053.g5 | 670 | TGCAAGAGCTTGGACGAGCGGGAGATT | 70996393 (*Aspergillus fumigatus*) |
| | 671 | AGGAAGGCCAAGCAGCTGGAGATGCA | 70823132 (*Aspergillus niger*) |
| | 672 | CTCGACGAGCTCTACATGGTTCTCATCAC | 62926964 (*Fusarium oxysporum* f. sp.) |

TABLE 8-continued

| Target ID | SEQ ID No | Sequence* | Example Gi-number and species |
|---|---|---|---|
| | 673 | CAGGATATCGACTCCCTGCACCT | 46122116 (*Gibberella zeae* PH-1) |
| | 674 | TACGAGGCTGAGAAGAACAAGTC | 46122116 (*Gibberella zeae* PH-1) |
| contig2.1499.g3 | 675 | ATCGCCAACACATCGAACATGCC | 70985197 (*Aspergillus fumigatus*) |
| | 676 | ATCATGAAGCGTACCACCCTT | 41565642 (*Cryptococcus neoformans* var.) |
| | 677 | ATCTGGAAGACAGAGTGGATGATG | 70675344 (*Gibberella moniliformis*) |
| | 678 | CAGGTCTTCTGGGGTCTCGACAAGAA | 70712111 (*Gibberella moniliformis*) |
| | 679 | GAGCGAGGCAATGAGATGGCTGAAGT | 70712110 (*Gibberella moniliformis*) |
| | 680 | TGGAAGACAGAGTGGATGATG | 70742555 (*Gibberella moniliformis*) |
| | 681 | ATGCCTGCTGATCAGGGTTTCCC | 46125252 (*Gibberella zeae* PH-1) |
| | 682 | GACCAGGTCGTGCAGCTTGTCGG | 46125252 (*Gibberella zeae* PH-1) |
| | 683 | CACTTCCCGTCCATCAACACTTC | 46343356 (*Paracoccidioides brasiliensis*) |
| | 684 | CAGCGCAAGCACTTCCCGTCC | 38064229 (*Phytophthora sojae*) |
| | 685 | CAGCGCAAGCACTTCCCGTCC | 38098094 (*Phytophthora sojae*) |
| | 686 | GCCGAGTACTTCCGTGACCAGGGCATGAACGT | 38098094 (*Phytophthora sojae*) |
| | 687 | TTCTGGGGTCTCGACAAGAAA | 49067893 (*Ustilago maydis*) |
| | 688 | AGCATTGTCGGTGCCGTCAGCCCGCCCGGTGGTGATTTCTC | 29426867 (*Verticillium dahliae*) |
| contig2.561.g35 | 689 | ATCGAGAAGACTGGCGAGAACTTCCG | 60673542 (*Alternaria brassicicola*) |
| | 690 | CCTCGCCCGGTCCTCACAAGC | 60673542 (*Alternaria brassicicola*) |
| | 691 | GTCAAGGTTGACGGCAAGGTCCGCACCGACTCGAC | 60673542 (*Alternaria brassicicola*) |
| | 692 | AACATGGGTCGTGTTGGTGTT | 48901692 (*Aspergillus flavus*) |
| | 693 | AGAACCATCCGCTACCCCGACCCT | 48901692 (*Aspergillus flavus*) |
| | 694 | CCATCGCTGAGGAGCGTGACCGC | 48901692 (*Aspergillus flavus*) |
| | 695 | GCAAGGTCAAGCGTGTTCAGCTCGGC | 48901692 (*Aspergillus flavus*) |
| | 696 | GGCGGGATCCCATTCTTGGTTACGCA | 48901692 (*Aspergillus flavus*) |
| | 697 | AACATGGGTCGTGTTGGTGTT | 49094939 (*Aspergillus nidulans* FGSC A4) |
| | 698 | ACTGGCAAGATCACCGACTTC | 49094939 (*Aspergillus nidulans* FGSC A4) |
| | 699 | ATCGAGAAGACTGGCGAGAACTTCCGTCTC | 49094939 (*Aspergillus nidulans* FGSC A4) |
| | 700 | CCCAAGGGCAAGGGTGTCAAGCTC | 49094939 (*Aspergillus nidulans* FGSC A4) |
| | 701 | GGCGGGATCCCATTCTTGGTTACGCA | 49094939 (*Aspergillus nidulans* FGSC A4) |
| | 702 | AAGCCCTGGATCTCCCTGCCCAAGGGCAAGGGTGTCAAGCTC | 70814642 (*Aspergillus niger*) |
| | 703 | ACCCACCGTGAGCGCCACGATGGTGG | 70814642 (*Aspergillus niger*) |
| | 704 | CCATCGCTGAGGAGCGTGACCGC | 70814642 (*Aspergillus niger*) |
| | 705 | CGCTTCACCGTCCACCGCATCCAGGC | 70823112 (*Aspergillus niger*) |
| | 706 | GACGGCAAGGTCCGCACCGAC | 70823112 (*Aspergillus niger*) |
| | 707 | GAGGAGGCCGAGTACAAGCTC | 70823112 (*Aspergillus niger*) |
| | 708 | GCAAGGTCAAGCGTGTTCAGCTCGGC | 10181989 (*Aspergillus niger*) |
| | 709 | GCAAGGTCAAGCGTGTTCAGCTCGGC | 70823112 (*Aspergillus niger*) |
| | 710 | TAAGAAGCACCAGAAGCGCCTT | 70823112 (*Aspergillus niger*) |
| | 711 | AAGATCACCGACTTCATCAAGTTCGACACTGG | 5831532 (*Botryotinia fuckeliana*) |
| | 712 | CGTGAGAGCAACGTTTTCGTCATCGG | 5831532 (*Botryotinia fuckeliana*) |
| | 713 | ATCAAGGTCAACGACACTGTCAAG | 41561006 (*Cryptococcus neoformans* var.) |
| | 714 | CTGCCCAAGGGCAAGGGTGTCAAGCTCACCATCGCTGAGGAGCGTGACCGC | 14664568 (*Fusarium sporotrichioides*) |
| | 715 | AACATGGGTCGTGTTGGTGTTATCAC | 70741411 (*Gibberella moniliformis*) |
| | 716 | CCATCGCTGAGGAGCGTGACCGC | 70741411 (*Gibberella moniliformis*) |
| | 717 | CGTGAGAGCAACGTTTTCGTCATCGGC | 70662858 (*Gibberella moniliformis*) |
| | 718 | CGTGAGAGCAACGTTTTCGTCATCGGC | 70685009 (*Gibberella moniliformis*) |
| | 719 | CGTGAGAGCAACGTTTTCGTCATCGGC | 70741411 (*Gibberella moniliformis*) |
| | 720 | CTGCCCAAGGGCAAGGGTGTCAAGCTCACCATCG | 70685009 (*Gibberella moniliformis*) |
| | 721 | CTGCCCAAGGGCAAGGGTGTCAAGCTCACCATCGCTGAGGAGCGTG | 70745388 (*Gibberella moniliformis*) |
| | 722 | GGGTGTCAAGCTCACCATCGCTGA | 70748989 (*Gibberella moniliformis*) |
| | 723 | TGCCCAAGGGCAAGGGTGTCAAGCTC | 70741411 (*Gibberella moniliformis*) |
| | 724 | ACAACATGGGTCGTGTTGGTGT | 22500577 (*Gibberella zeae*) |
| | 725 | CAAGGCCATCCTGATGCAGCG | 47836630 (*Gibberella zeae*) |
| | 726 | CGAGGAGGCCGAGTACAAGCT | 22501231 (*Gibberella zeae*) |
| | 727 | ATCCCATTCTTGGTTACGCATGA | 47032032 (*Mycosphaerella graminicola*) |
| | 728 | CGAGGAGGCCGAGTACAAGCT | 47032032 (*Mycosphaerella graminicola*) |
| | 729 | AACTTCCGTCTCGTCTACGACACCAAGGG | 46345858 (*Paracoccidioides brasiliensis*) |
| | 730 | CGCCACGATGGTGGCTTCAACATTGT | 24455928 (*Paracoccidioides brasiliensis*) |
| | 731 | CCCCGCCGGCTTCATGGACGT | 40545328 (*Phytophthora nicotianae*) |
| | 732 | CCCCGCCGGCTTCATGGACGT | 68416641 (*Phytophthora parasitica*) |
| | 733 | AAGATCACCGACTTCATCAAGTTCGACAC | 40545852 (*Sclerotinia sclerotiorum*) |
| | 734 | CGTGAGAGCAACGTTTTCGTCATCGG | 40545852 (*Sclerotinia sclerotiorum*) |
| | 735 | CTCATCGTCTTCATCCGCAACCG | 40545852 (*Sclerotinia sclerotiorum*) |
| | 736 | ATCAAGGTCAACGACACTGTC | 37404210 (*Ustilago maydis*) |
| | 737 | GACCCTCTGATCAAGGTCAACGACAC | 29426157 (*Verticillium dahliae*) |
| | 738 | GAGGAGGCCGAGTACAAGCTCGGCAAGGTCAAGCGTGT | 29426157 (*Verticillium dahliae*) |
| | 739 | GGCAAGATCACCGACTTCATCAAGTTCGACAC | 29426157 (*Verticillium dahliae*) |
| | 740 | GTCAAGGTTGACGGCAAGGTCCGCACCGAC | 29426157 (*Verticillium dahliae*) |

TABLE 8-continued

| Target ID | SEQ ID No | Sequence* | Example Gi-number and species |
|---|---|---|---|
| contig2.875.g14 | 741 | CCTCGCGGTGCCATGATCTTCT | 71000869 (*Aspergillus fumigatus*) |
| | 742 | AACAAGTATTCCGAGGGTTACCCCGG | 49091467 (*Aspergillus nidulans* FGSC A4) |
| | 743 | CGCGGTGCCATGATCTTCTTC | 70682910 (*Gibberella moniliformis*) |
| | 744 | TCCGTCTTCCCCGGTCACCAGGG | 70682910 (*Gibberella moniliformis*) |
| | 745 | TCCGTCTTCCCCGGTCACCAGGGCGG | 70685149 (*Gibberella moniliformis*) |
| | 746 | TACGACCTTGAGAACCCCATCAAC | 46123824 (*Gibberella zeae* PH-1) |

TABLE 9

| Target ID | SEQ ID No | Sequence* | Example Gi-number and species |
|---|---|---|---|
| MGG09222.5 | 747 | CGTCATCCCCGTCCGTCGTGGTTACTGGGGTA | 17972115 (*Nippostrongylus brasiliensis*) |
| MG00604.4 | 748 | AACTCGACCGCCATCCAGGAGCTGTTCAAGCG | 28706250 (*Heterodera glycines*) |
| | 749 | ATCCAGGAGCTGTTCAAGCGT | 159160 (*Haemonchus contortus*) |
| | 750 | CAACATGAACGATCTTGTTTC | 72003699 (*Caenorhabditis elegans*) |
| | 751 | CAGAACAAGAACTCGTCGTACTTCGT | 23260428 (*Ascaris lumbricoides*) |
| | 752 | CATTGGTACACTGGTGAGGGTATGGACGAGATGGAGTTC | 6081554 (*Pristionchus pacificus*) |
| | 753 | CCCAAGAACATGATGGCTGCTT | 71184729 (*Caenorhabditis remanei*) |
| | 754 | GAGGCCGAGTCCAACATGAACGATCTTGT | 28706250 (*Heterodera glycines*) |
| | 755 | GAGGGTATGGACGAGATGGAGTTCAC | 28706250 (*Heterodera glycines*) |
| | 756 | GATCTCCGCAAGCTTGCCGTCAACATGGTTCCC | 47663797 (*Caenorhabditis elegans*) |
| | 757 | GCCGAGTCCAACATGAACGAT | 27428224 (*Heterodera glycines*) |
| | 758 | GCCGTCAACATGGTTCCCTTCCC | 6067860 (*Pristionchus pacificus*) |
| | 759 | GCTTTCTTGCATTGGTACACTGG | 53809993 (*Xiphinema index*) |
| | 760 | GGTATGGACGAGATGGAGTTCACTGA | 53748584 (*Cyathostomum catinatum*) |
| | 761 | GTCGAGTGGATCCCCAACAAC | 28185390 (*Ancylostoma ceylanicum*) |
| | 762 | TCCGAGTACCAGCAGTACCAGGA | 6081554 (*Pristionchus pacificus*) |
| | 763 | TCCGAGTACCAGCAGTACCAGGATGC | 28706250 (*Heterodera glycines*) |
| | 764 | TGAGCAGTTCACTGCCATGTTC | 3046904 (*Onchocerca volvulus*) |
| | 765 | TTCTTGCATTGGTACACTGGTGAGGGTATGGA | 68303302 (*Ancylostoma caninurn*) |
| | 766 | GAGGCTGAGGGCTGTGACTGCCT | 21393141 (*Nippostrongylus brasiliensis*) |
| | 767 | GACTGCCTCCAGGGTTTCCAG | 27926935 (*Ascaris suum*) |
| | 768 | GACGAGACCTTCTGCATTGACAACGAGGC | 6067860 (*Pristionchus pacificus*) |
| | 769 | GGAAACAACTGGGCCAAGGGTCACTACAC | 71983644 (*Caenorhabditis elegans*) |
| | 770 | TTCTGCATTGACAACGAGGCTCT | 71983644 (*Caenorhabditis elegans*) |
| | 771 | TGGTGCTGGAAACAACTGGGCCA | 754758 (*Caenorhabditis briggsae*) |
| MG5858.4 | 772 | ATTCAGTCCGTCAAAGGAAAGGTTGT | 28559556 (*Ancylostoma ceylanicum*) |
| | 773 | TTGATGTTTTTGCCATGCCACAA | 30165647 (*Meloidogyne chitwoodi*) |
| MGG02952.5 | 774 | CTCAAGAACAAGCGTGAGGTCTGGCGTGTC | 71988689 (*Caenorhabditis elegans*) |
| | 775 | CTCGCCAAGTCCATCCACCACGCCCGT | 18090904 (*Parastrongyloides trichosuri*) |
| | 776 | GACTCCCAGAAGCACATCGACTTC | 71988689 (*Caenorhabditis elegans*) |
| | 777 | GTCTCAAGAACAAGCGTGAGGT | 20133278 (*Ostertagia ostertagi*) |
| MGG04095.5 | 778 | ATCAAGGTCAACGACACTGTC | 15666921 (*Ancylostoma ceylanicum*) |
| | 779 | GCCGAGGAGGCCGAGTACAAGCTC | 32320500 (*Heterodera glycines*) |
| | 780 | TTCGGAGAAATGGAACGTGAT | 6067677 (*Pristionchus pacificus*) |
| MGG04829.5 | 781 | AACAAGGATATCCGTAAGTTCTTGGA | 45213836 (*Wuchereria bancrofti*) |
| | 782 | TACGCCCATTTCCCCATCAACGTCA | 15498642 (*Haemonchus contortus*) |
| MGG06910.5 | 783 | CAGGTCTTCTGGGGTCTCGACAAGAAACT | 17994314 (*Ascaris suum*) |
| MGG09952.5 | 784 | ACCTACAAGAACGTCCCCAACTGGCAC | 18826906 (*Pristionchus pacificus*) |
| | 785 | GTGAAGGCCAAGACCATCACCTTCCAC | 47598490 (*Caenorhabditis elegans*) |
| | 786 | TACAACTTCGAGAAGCCTTTCCT | 32183546 (*Meloidogyne chitwoodi*) |
| | 787 | TTCGAGAAGCCTTTCCTGTGG | 60292774 (*Angiostrongylus cantonensis*) |
| contig2.1499.g3 | 788 | CAGGTCTTCTGGGGTCTCGACAAGAAACT | 17994314 (*Ascaris suum*) |
| | 789 | GCCGAGTACTTCCGTGACCAGG | 31246711 (*Caenorhabditis elegans*) |
| MG04484.4 | 790 | TCCAAGGGCCGCAAGTTCGAG | 29053280 (*Heterodera glycines*) |

TABLE 10

| Target ID | SEQ ID No | Sequence* | Example Gi-number and species |
|---|---|---|---|
| MG00604.4 | 791 | AAGGCTTTCTTGCATTGGTACACTGG | 77881122 (*Aedes aegypti*) |
| | 792 | ACCGCCATCCAGGAGCTGTTCAAGCG | 4163124 (*Bombyx mori*) |
| | 793 | ATGGACGAGATGGAGTTCACTGAGGCCGAG | 67888072 (*Drosophila pseudoobscura*) |
| | 794 | ATGTTCAGGCGCAAGGCTTTCTTGCATTGGTACAC | 4163124 (*Bombyx mori*) |
| | 795 | GAGGGTATGGACGAGATGGAGTTCAC | 77676133 (*Aedes aegypti*) |
| | 796 | GCCATCCAGGAGCTGTTCAAGCG | 33552986 (*Anopheles gambiae*) |
| | 797 | GCTTTCTTGCATTGGTACACTGGTGA | 47515641 (*Acyrthosiphon pisum*) |
| | 798 | GTCGAGTGGATCCCCAACAAC | 61951569 (*Tribolium castaneum*) |
| | 799 | GTTTCCGAGTACCAGCAGTACCAGGA | 75465871 (*Tribolium castaneum*) |
| | 800 | TCCGAGTACCAGCAGTACCAGGA | 4419807 (*Drosophila melanogaster*) |
| | 801 | TGGTACACTGGTGAGGGTATGGA | 40935930 (*Bombyx mori*) |
| | 802 | GCTGGAAACAACTGGGCCAAGGGTCA | 47518574 (*Acyrthosiphon pisum*) |
| | 803 | CTCGAGCCCGGCACCATGGACGCCGT | 6910199 (*Bombyx mori*) |
| | 804 | CTGCATTGACAACGAGGCTCT | 29535524 (*Bombyx mori*) |
| | 805 | CTGCATTGACAACGAGGCTCTGTACGACATCTGC | 40918504 (*Bombyx mori*) |
| | 806 | GACAACTTCGTCTTCGGTCAGTC | 6910199 (*Bombyx mori*) |
| | 807 | GGTGCTGGAAACAACTGGGCCAA | 34787982 (*Callosobruchus maculatus*) |
| | 808 | CATGTCTGGCGTCACCACCTGC | 25957081 (*Carabus granulatus*) |
| | 809 | AACAACTGGGCCAAGGGTCACTACACTGA | 158744 (*Drosophila hydei*) |
| | 810 | GACGAGACCTTCTGCATTGACAACGAGGCTCT | 67885077 (*Drosophila pseudoobscura*) |
| | 811 | GGAAACAACTGGGCCAAGGGTCACTACAC | 67875471 (*Drosophila pseudoobscura*) |
| | 812 | ATCTCCAAGATCCGCGAGGAGT | 78052349 (*Heliconius erato*) |
| | 813 | CTTCCGCCCCGACAACTTCGT | 78050966 (*Heliconius erato*) |
| | 814 | TCTTCCGCCCCGACAACTTCGT | 78052742 (*Heliconius erato*) |
| | 815 | CCGACAACTTCGTCTTCGGTCAG | 55911790 (*Locusta migratoria*) |
| | 816 | GAGGGTGCCGAGCTTGTCGAC | 55911790 (*Locusta migratoria*) |
| | 817 | GACAACTTCGTCTTCGGTCAGTC | 58371315 (*Lonomia obliqua*) |
| | 818 | CTCGAGCCCGGCACCATGGAC | 10763921 (*Manduca sexta*) |
| | 819 | CCCCGACAACTTCGTCTTCGG | 75714350 (*Tribolium castaneum*) |
| | 820 | TTCCGCCCCGACAACTTCGTCTTCGG | 75711493 (*Tribolium castaneum*) |
| MG00961.4 | 821 | GGTCTCATGTTAGCCAACCACACCA | 55889923 (*Locusta migratoria*) |
| MG02946.4 | 822 | CGGCAGCTGCGACTGCGGCCG | 58395387 (*Anopheles gambiae* str. PEST) |
| MG04484.4 | 823 | CTCTTGGTGAAGCTCTACCGCTT | 56154926 (*Rhynchosciara americana*) |
| | 824 | GTTGTCGGCACCGTCACCGACGA | 4245179 (*Drosophila melanogaster*) |
| MG5858.4 | 825 | CATCCCGGTTTCGGCTGCTGG | 17945075 (*Drosophila melanogaster*) |
| | 826 | GTGGATATCAACACTCAGCAG | 77871215 (*Aedes aegypti*) |
| MGG02952.5 | 827 | AACAAGCGTGAGGTCTGGCGTGTC | 61675474 (*Aedes aegypti*) |
| | 828 | CGCATGAAGCTCGATTACGTTCT | 3946433 (*Drosophila melanogaster*) |
| | 829 | CTCGACTCCCAGAAGCACATCGACTTC | 49209929 (*Drosophila melanogaster*) |
| | 830 | GACGAGTCGCGCATGAAGCTCGATTACGT | 56772258 (*Drosophila virilis*) |
| | 831 | TGGTCTCGCCAAGTCCATCCACCACGCCCG | 49532931 (*Plutella xylostella*) |
| MGG04095.5 | 832 | ACTTACCCCGCCGGCTTCATGGA | 58371410 (*Lonomia obliqua*) |
| MGG04829.5 | 833 | AACAAGGATATCCGTAAGTTCTTGGA | 42766318 (*Armigeres subalbatus*) |
| | 834 | CCACCCTCCGTACCGTCCGCAC | 77778750 (*Aedes aegypti*) |
| | 835 | GAACAAGGATATCCGTAAGTTC | 15046304 (*Drosophila melanogaster*) |
| | 836 | GATATCCGTAAGTTCTTGGATGGT | 60298646 (*Diaphorina citri*) |
| | 837 | TACGCCCATTTCCCCATCAAC | 15046304 (*Drosophila melanogaster*) |
| MGG05193.5 | 838 | AACCAGCTGCTGACGGAGATGGACGG | 58388417 (*Anopheles gambiae* str. PEST) |
| MGG06910.5 | 839 | CAGCGCAAGCACTTCCCGTCCATCAAC | 22474258 (*Helicoverpa armigera*) |
| | 840 | TTCTGGGGTCTCGACAAGAAACT | 55915724 (*Locusta migratoria*) |
| MGG09222.5 | 841 | CGGCAAGTGCGGTTCCGTCAC | 60313286 (*Sphodromantis centralis*) |
| MGG09952.5 | 842 | AAGAACCTGCAGTATTACGACATCTC | 25959135 (*Meladema coriacea*) |
| | 843 | CAGTATTACGACATCTCGGCCAAGTC | 77843224 (*Aedes aegypti*) |
| | 844 | TCACCTACAAGAACGTCCCCAACTGGCAC | 77843224 (*Aedes aegypti*) |
| contig2.1053.g5 | 845 | CAATTTCGCCATCGATATGGCC | 13773184 (*Drosophila melanogaster*) |
| contig2.1499.g3 | 846 | GCCGAGTACTTCCGTGACCAG | 48719395 (*Anopheles funestus*) |
| | 847 | CAGCGCAAGCACTTCCCGTCCATCAAC | 22474258 (*Helicoverpa armigera*) |
| | 848 | TTCTGGGGTCTCGACAAGAAACT | 55915722 (*Locusta migratoria*) |
| | 849 | AAGGAAGCAGAGGAAGAAGAAA | 75717792 (*Tribolium castaneum*) |
| contig2.561.g35 | 850 | GACGGCAAGGTCCGCACCGAC | 77724691 (*Aedes aegypti*) |
| | 851 | CGAGGAGGCCGAGTACAAGCT | 27616676 (*Anopheles gambiae*) |
| | 852 | ATCTCCCTGCCCAAGGGCAAGGTGTCAAGCT | 67882036 (*Drosophila pseudoobscura*) |

TABLE 10-continued

| Target ID | SEQ ID No | Sequence* | Example Gi-number and species |
|---|---|---|---|
| | 853 | TCAAGGTTGACGGCAAGGTCCGCAC | 48927129 (*Hydropsyche* sp.) |
| | 854 | ACTTACCCCGCCGGCTTCATGGA | 58371411 (*Lonomia obliqua*) |
| MG00170.4 | 855 | CGGTTGGGTCAAGCACGGATT | 40946757 (*Bombyx mori*) |
| | 856 | CAGGGATGCCTACTCCGGTGGT | 17862097 (*Drosophila melanogaster*) |
| MG04484.4 | 857 | AAGGGCCGCAAGTTCGAGAAGGC | 27569966 (*Anopheles gambiae*) |
| | 858 | GTTGTCGGCACCGTCACCGACGA | 4245179 (*Drosophila melanogaster*) |
| | 859 | CTCTTGGTGAAGCTCTACCGCTT | 56154926 (*Rhynchosciara americana*) |

SEQUENCE LISTING (859 sequences)

SEQ ID NO: 1 - DNA, 855 bp, Magnaporthe grisae
atggacaccctggtagcccgctacagccgcccggcttaccagcagaacgagacattcacagaagatgatcagcaagacctttgcgattccgtcccaagtctttcactcaagtttgcggttccgccagtagcacatccctcatcttggctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatgggtaccatgtgcgccggcgtcaccaaggaggagggtcccgccctgtactacatcgacagcgacggcaccaggcttgccggcaatctgttctgtgtgggatccggtcagacctttgcctatggtgtgctggatgccgagtacaagtacgacctgtcggatgaggatgcgctcgagctcggccgcaggagcattctcgccgccacccacagggatgcctactccggtggttttatcaacttgtaccacgtcaaggaggacggttgggtcaagcacggattcaacgacacgaaccctatcttctggaagactaagctggagaagggcgagtttaccaacgttacgagtgcgctggactag

SEQ ID NO: 2 - protein, 284 aa, Magnaporthe grisae
MDTLVARYSRPAYQQNETFTEDDQQDLCDSVPSLSLKFAVPPVAHPSSWLRTATDDHANPNCPIKIAHGTTTLAFRFQGGIIVATDSRATAGNWIASQTVKKVIEINSCLLGTMAGGAADCQYWLAWLGMQCRLHELRHKRRISVAAASKILANLVYQYKGMGLSMGTMCAGVTKEEGPALYYIDSDGTRLAGNLFCVGSGQTFAYGVLDAEYKYDLSDEDALELGRRSILAATHRDAYSGGFINLYHVKEDGWVKHGFNDTNPIFWKTKLEKGEFTNVTSALD

SEQ ID NO: 3 - DNA, 1674 bp, Magnaporthe grisae
atgaaggacgagacatcacgaaagaccaagggaaagaagctcaaggagggtgacgaagaaatgactgtcgttgtaccgccgtccaagtcgtccaagcagtcgccaccgacccgatcggacgaggacgtagacatggacgagtctggaaaggttgatgatgccgaagtcaaggttgacccagcagttcaggccgtcgcagatatcaagagcaatttcgccctgttggacaaagctgttgctttgttcgatgcaagattcacgctgcgtgctctgcggtccatttcatccatccgcaaacggttgaccgccgacatcctcgcccaggcgattgccgagacgtttcctccgaccgcagcgtcaggggacgcagtcaaacaactgctcgcgagcatcggcaagcaagacgtgcaactcggacgccagtcgggctctgagatggagatcgatggcgaggtcaagggccagtcaaagacgagcagctctaagaaggagagcaaagagatcatcccagagattgacatcttcatgggaatcctcacccaggttttcctctatgattctaagcagcttgagcgcggagccgaattctcccagcacctttgcgaacggatccactccctcaaccgtcgtacactagactcgctttcggccaaggtttacttttactactcgctcttcttcgagaagcttgcgcctctgccgccgtctccgcagtcgccatccgtgtctatccgcccaaccctcctcgccgccctccggactgccgtgttgagaaaggatattgatacacaggcctcggtcattgtgctgctgctgcgcaactacctcgccacgtcgcacatcaaccaggccgacctgctcgtctcacatacacagttccccgagaatgctgcaaacaaccaagttgcgcggtatctctactaccttggtcggattcgcgccatacagctgcgctacacggaggcacacgagcacctgacggctgcgacgcggaaggcaccgagctctaactgcgcggttggtttctcgcagacggccaccaagcttttgctggtggttgagcttcttatgggcgatattcctgatcgcgcgaccttccgccaaccgaccctcgaggaggcactgcacccttacttcctgctagtccaggctgttcgggtcggtaacctcgacaacttcgagacgaccattgcggaccacgccgatactttccgcaaggacggaacctacaccctcatcctccgacttcgccagaacgttatcaggacgggtattagaatgatgtcgctttcgtacagccgcatctcgcttcgtgacatttgcatccggcttcacctcggcagcgaagagtcagccgagtacattgttgccaaggccattagggacggtgtcattgaggccaccctggaccgcgagcacggctacatgaggagcaaggaggtcggtgatgtgtacgccacgcgggagccaggcgaggctttccacgatcgcatccgtgcctgcctcgcgctccacgatgagagcgtcaaggccatgcgcttccccatgaaccagcaccgtcttgagcttaagaacgctcaagaggcgcgtgagcgtgagcgggagatggccaaggagatacaggatggagatcttgacgaggacgaccttgggggagaattcgagggcatgtaa

SEQ ID NO: 4 - protein, 557 aa, Magnaporthe grisae
MKDETSRKTKGKKLKEGDEEMTVVVPPSKSSKQSPPTRSDEDVDMDESGKVDDAEVKVDPAVQAVADIKSNFALLDKAVALFDARFTLRALRSISSIRKRLTADILAQAIAETFPPTAASGDAVKQLLASIGKQDVQLGRQSGSEMEIDGEVKGQSKTSSSKKESKEIIPEIDIFMGILTQVFLYDSKQLERGAEFSQHLCERIHSLNRRTLDSLSAKVYFYYSLFFEKLAPLPPSPQSPSVSIRPTLLAALRTAVLRKDIDTQASVIVLLLRNYLATSHINQADLLVSHTQFPENAANNQVARYLYYLGRIRAIQLRYTEAHEHLTAATRKAPSSNCAVGFSQTATKLLLVVELLMGDIPDRATFRQPTLEEALHPYFLLVQAVRVGNLDNFETTIADHADTFRKDGTYTLILRLRQNVIRTGIRMMSLSYSRISLRDICIRLHLGSEESAEYIVAKAIRDGVIEATLDREHGYMRSKEVGDVYATREPGEAFHDRIRACLALHDESVKAMRFPMNQHRLELKNAQEAREREREMAKEIQDGDLDEDDLGGEFEGM

SEQ ID NO: 5 - DNA, 702 bp, Magnaporthe grisae
  misc_feature (373)..(373): This nucleotide may or may not be present
atgggtagcctgatcggatcattttcctgggtcagccccaccaaagttgttccggcaggcggtagcggagcttcgcagaacacactcaatatggaggttcttttggggatcacgggcaaggacttcaccttgatcgcagcrtccaaggctgcgatgcggggagccaccgttcttaaggcatctgacgacaagacgaggccactcaacaagcacaccatgattgcattttcgggcgagcctggagacaccatccagtttgcggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctcagtactactgcctctccatcctcgacaaacatcaccatcccgatatcaccctgcaccagggtatcaagatcctgactatgtgcaccgacgagctgaagaggagattaccgattgacttcaaaggaatggtggtgaaggcggtgacaaaggatggaatccgagacatcgaatttgatgatgacaagattgtcaagagtgcttga

SEQ ID NO: 6 - protein, 233 aa, Magnaporthe grisae
MGSLIGSFSWVSPTKVVPAGGSGASQNTLNMEVLLGITGKDFTLIAASKAAMRGATVLKASDDKTRPLNKHTMIAFSGEPGDTIQFAEYIMANAKLYSMRNETDLSPSALAHYVRGELASSLRSRKPYTVNLLLGGVDPITHKPSLYWLDYLAALAPVPYAAHGYAQYYCLSILDKHHHPDITLHQGIKILTMCTDELKRRLPIDFKGMVVKAVTKDGIRDIEFDDDKIVKSA

SEQ ID NO: 7 - DNA, 555 bp, Magnaporthe grisae
atgggtatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgccaacaccctcctcctccgcggccccaagaacgcccgtgaggctgtcaagcacttcggcttcggtccccacaagcacaagaagccttacgtccagtccaagggccgcaagttcgagaaggcccgtggtcgcagacgatcgcgtggtttcaaggtctaa

SEQ ID NO: 8 - protein, 184 aa, Magnaporthe grisae
MGIDLKKHHVRSTHRKAPKSDNVYLKLLVKLYRFLARRTDSSFNKVVLRRLFMSRTNRPPVSLSRIAGNLKNGNEKKTVVVVGTVTDDNRLVECPKAQVAALRFTATARARIVAAGGQAITLDQLALEKPTGANTLLLRGPKNAREAVKHFGFGPHKHKKPYVQSKGRKFEKARGRRRSRGFKV

SEQ ID NO: 9 - DNA, 1611 bp, Magnaporthe grisae
atggcgaccaacggcgatgctgctcccccggcgccggcggcagagacggcagctgcgactgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcggccgcgttggcggccgccaagctggcagagcagaacaaggagccccagggcccgcccaagccgccggattttgagttctcggcgcgcatgccgaggatgaaccagaaggatcttgagatattgagggtcacggcgctgttcgtggccaggaacggaaggcaatttcagacccagctaatgcaacgcgagactaagaatccgcagtttcagtttcttatcccgaatcacaccttccacaatttcttccagcatatggtagatcagtacgccatcatactcaaggagagtggcatgggaggggatggatctaaggcccaggagcagcgaattgagcagctgcggcgcaatgtcgaggatcggttccacattctggagagggcaaaacagcgggctgagtatgcagtatggcaggagcaggagaggcagaagcaggaggctgccgaggagaagaagaaggatgactttgcacgcatcgactggaatgactttgtcgtggttgagactattgatttcaccgaggcagatgccaatattaccctcccaccgccgacgactctcaacgacatacaatacgcatcattggaggagaagcaaaacttctcagtcaacgccaagcgtatcgaagaggcattcccctttgatgataccagctacaatgcctatccggtacagcaacagcaatcacaaccagcacaacaagactcaccggcaggggcaccggcacagccggcacacatgcagcaggaccccgaggagacgcggaggatacaagaaagggaacaagcccgggcgcgcatgcaccaagcccaggcagatgccagaggaggaacggctccaatgaagatcaaggaaaactacgtacccaaagcggctgcccggggtccgaggaccggaggccagacggctctgtgtccaagatgtaaccagcagatcctcttgtcggagtgggaggagcacatgaggatcgaactgctggatcccaggtggaaggagcaaaaggccaaggcagagtcgcgatacgcgacgaccaacatatcgacggcggatgtggccaacaacctgaagcgtctggcgagccaaaggacggacgtgttcgacagcgtcacgggccagccgctctcggaggaggagatggcccgtcgcaaaaaggcagccatcaacagctacgatggaaaccccgacggcaagagccaggcgcacattgcacacctgcagcacgtcaatgtcgaggagcagatcagggctatccagcaaaagtttggagacaaaaaggaataa

SEQ ID NO: 10 - protein, 536 aa, Magnaporthe grisae
MATNGDAAPPAPAAETAAATAAAAQLDGLRPPEGVIIPPPGEIREVIEKTAGYVARGGLGIEQRLRENHSGNPKFSFVTSQSDAYNPYYEWRKAEYKAGRGTALAAGRADAAALAAAKLAEQNKEPQGPPKPPDFEFSARMPRMNQKDLEILRVTALFVARNGRQFQTQLMQRETKNPQFQFLIPNHTFHNFFQHMVDQYAIILKESGMGGDGSKAQEQRIEQLRRNVEDRFHILERAKQRAEYAVWQEQERQKQEAAEEKKKDDFARIDWNDFVVVETIDFTEADANITLPPPTTLNDIQYASLEEKQNFSVNAKRIEEAFPFDDTSYNAYPVQQQQSQPAQQDSPAGAPAQPAHMQQDPEETRRIQEREQARARMHQAQADARGGTAPMKIKENYVPKAAARGPRTGGQTALCPRCNQQILLSEWEEHMRIELLDPRWKEQKAKAESRYATTNISTADVANNLKRLASQRTDVFDSVTGQPLSEEEMARRKKAAINSYDGNPDGKSQAHIAHLQHVNVEEQIRAIQQKFGDKKE

SEQ ID NO: 11 - DNA, 999 bp, Magnaporthe grisae
atgcactcgccgccgcggaagttgacggctcaggaccaggaggactggaggataccgccgccaatctcaaactggaagaaccccaagggtttcacggtaccgctggacaagcgtctggccgccgacgggaggggtctacaggacgtcacgatcaacgacaaattcgcacagctatcagagtctctgtacgtcgccgacagacatgcacgtgaggaagttaagcagagggcgctcatgcagcagcgcctggcagagaaggagaaggcccagaaggaggagaatctgaggcagctggcacaaaaggcgagggaagagcgtgccggtgccggaagcagacgacggtccaggtctggcagccgcagcagccgatcctattcgtctggctcagacagcgaggaatctgacatccgagagcgtgaggaggcaaggaaagagcgacgcaaggaggaggaacgcaaattacgacagtctaggatgggagcggagaggagagtacaagtcatggcacgggagcagaaccgagatatttctgagaagattgcgctgggactcgccaagcccacgcagtcgtcagaaggcatgtacgattctcgacttttcaaccaatcatctggtttcgagggcggcatcaacgaggacaacccttatgacaagccgctttttgctgttcaggacgccatcagtagtatctaccggccccgtgcgaacaacgatgatgaggacgaggcggctggcgatgcggagatggccaagatacaaaaggcgagcagatatggtgaggtgctaggccgaggtacattctccggtgccggggatgtggaagcccgagaaggtccagtgcagttcgaaaaggatgctgcaggcgcggaccctttcaatgtggacaagttcctgtccgaggtcgaacagaccgcgtcatcaaagaggggttatggtctgcaagactcgagcaacgatggcggcaggccgaagagggctagggtggaggacgacgattga

SEQ ID NO: 12 - protein, 332 aa, Magnaporthe grisae
MHSPPRKLTAQDQEDWRIPPPISNWKNPKGFTVPLDKRLAADGRGLQDVTINDKFAQLSESLYVADRHAREEVKQRALMQQRLAEKEKAQKEENLRQLAQKAREERAGAGSRRRSRSGSRSSRSYSSGSDSEESDIREREEARKERRKEEERKLRQSRMGAERRVQVMAREQNRDISEKIALGLAKPTQSSEGMYDSRLFNQSSGFEGGINEDNPYDKPLFAVQDAISSIYRPRANNDDEDEAAGDAEMAKIQKASRYGEVLGRGTFSGAGDVEAREGPVQFEKDAAGADPFNVDKFLSEVEQTASSKRGYGLQDSSNDGGRPKRARVEDDD

SEQ ID NO: 13 - DNA, 2631 bp, Magnaporthe grisae
atggcgacgtcagacatcacgacggtgctcacaaattcgctgtctgccgatgcgaacctgcgacatgccgccgaacagcagctcacacaggcggctgagaccaacttttcattataccttgcgactcttgttaccgagctagcaaatgagaatgccccgggtcacattcgagctgccgctggtattgcggtgaagaacgcgttcacagcccgcgagttcagccgtcaaactgaactgcaacaaaaatggcttcaacaaacagacgacgaaaccagggcaaaggtcaagagtctcactctacagaccttgtcgtcaaccaactcccaggctggccaggccgccgcccaggtcatcgcctccatcgctggaatcgagcttccccgtggacaatgggccgacttgatgaacatcctcgtcacaaatgtcagcgagggtcaaccccaccagaagcaggcatctctgactacgataggattcatctgcgagagtcaagatcctgagctccgcgctagcttggtcgaccactccaacgctatcctgacggccgtcgtccagggtgctaggaaggaggagaccaacaatgagatcaggctggccgccatcactgccctcggagactcgctcgagttcgtcggtaacaacttcaagcacgagggcgagcgcaactacatcatgcaagttgtctgcgaggccacacagggcgacgactcacgcatccagcagggtgcctttggttgcctgaaccgtatcatggccctttactacgaaaacatgcgtttctatatggagaaggcgcttttcggcttgaccattttgggcatgaagagcgaagacgaggacgttgccaagctggctgttgagttctggagcaccgtttgtgaagaggagattgccatcgaggacgacaacgcacaggtcgagagcgcggatcaggtcaggccgttttacaacttcgcccgcgtggcaaccaacgaggtggtccccgtcctcctcacccttctcaccaagcaagatgaggacgccgccgacgacgagtacaacatttctcgtgctggctaccagtgtctgcaactttacgcccaggctgttggtggcaccattatcccgcctgttatctcctttgttgagggcaacctccgatccgatgactggcacaacagggatgcggctgtctctgcttttggtgccattatggagggtcccgacgagaagactctggagccgattgtcaagtccgctctgcaaattctcatctcaatgatggacgactcctcggtacacgtcaaggactcgaccgcttacgctcttggtcgcatcaccgaggcctgctcygaggctattgaccccagccagcacctcgagcctctgatccgctcgttgtttgctggcctgctaaacactcccaagatggccgcctcgtgctgttgggctctgatgaacctggcggaacgttttgccggtgagcccggagcgccccagaatgccatcactgcctacttcaacgacagtgtgcgcagcctcctggacgtcaccgccaagaacgattgcgactcggctgtcaggacggccgcgtatgaggttctcaacgctttcatcgtcaatgcggcaaacgatagtctgcaggctgttgccactctttcggatgttatcatcaagcgcctagaggagacgataccactacagacccaggttgtcagcgtcgaggaccgtattacactcgaggacatgcagaccagtctgtcgactgttcttcaggccatcatcggccgtcttgacaaggaaatccttcctcagggcgaccgaatcatgcaggtgctgctgcagattctgtcaacggtcaacggcaagtccactgttcccgaggctattttcgccaccatcagtagccttgccaatgctatcgaggaagagtttgtcaagtacatggatgcctttgcgccgttcctctacaatgctctgggtaaccaggaagaacccagcctgtgctccatggctatcggcctcgtgagcgacattacaaggtcaatgggcgaacgcagccaaccgtactgtgacaactttatgaactatctccttaacaacctgaggagctcaacactttccaaccaattcaagcctgccattctgcagtgcttcggggacattgccaacgccattggcggccactttgagacttatctgtctgttgtggctcaagttttgcaacaagcctccactgttaccacagtacccgagggctcatatgagatgttcgactacgtcgtctcattgagggagggtattatggacgcctggggcggcattattggtgccatgaagagcgccaacaagacccaagccctccagccttatgtcccatccattttcgagctgctgaaccacattggtagcgactcgaaccgtagcgagtctctgatgcgcagttccatgggtgttattggcgatcttgccgatgcctaccccaacggggagctcgtggatgctttccgtcaggrctgggttactrctattatcaaggagacgcgttccaaccgcgagttttcaycgcggacaatcgagacggcacgctgggcacgtgagcaggtcaagcgtcaacttgggggttccgtcaatgtcatgcagcagacttga

SEQ ID NO: 14 - protein, 876 aa, Magnaporthe grisae
MATSDITTVLTNSLSADANLRHAAEQQLTQAAETNFSLYLATLVTELANENAPGHIRAAAGIAVKNAFTAREFSRQTELQQKWLQQTDDETRAKVKSLTLQTLSSTNSQAGQAAAQVIASIAGIELPRGQWADLMNILVTNVSEGQPHQKQASLTTIGFICESQDPELRASLVDHSNAILTAVVQGARKEETNNEIRLAAITALGDSLEFVGNNFKHEGERNYIMQVVCEATQGDDSRIQQGAFGCLNRIMALYYENMRFYMEKALFGLTILGMKSEDEDVAKLAVEFWSTVCEEEIAIEDDNAQVESADQVRPFYNFARVATNEVVPVLLTLLTKQDEDAADDEYNISRAGYQCLQLYAQAVGGTIIPPVISFVEGNLRSDDWHNRDAAVSAFGAIMEGPDEKTLEPIVKSALQILISMMDDSSVHVKDSTAYALGRITEACSEAIDPSQHLEPLIRSLFAGLLNTPKMAASCCWALMNLAERFAGEPGAPQNAITAYFNDSVRSLLDVTAKNDCDSAVRTAAYEVLNAFIVNAANDSLQAVATLSDVIIKRLEETIPLQTQVVSVEDRITLEDMQTSLSTVLQAIIGRLDKEILPQGDRIMQVLLQILSTVNGKSTVPEAIFATISSLANAIEEEFVKYMDAFAPFLYNALGNQEEPSLCSMAIGLVSDITRSMGERSQPYCDNFMNYLLNNLRSSTLSNQFKPAILQCFGDIANAIGGHFETYLSVVAQVLQQASTVTTVPEGSYEMFDYVVSLREGIMDAWGGIIGAMKSANKTQALQPYVPSIFELLNHIGSDSNRSESLMRSSMGVIGDLADAYPNGELVDAFRQDWVTAIIKETRSNREFSSRTIETARWAREQVKRQLGGSVNVMQQT

SEQ ID NO: 15 - DNA, 3222 bp, Magnaporthe grisae
atgcctcctccaccgcatcaaaaacctgaaaatgtcctcaagcgcgcccatgagctcatcggcgtcaaccaggcccctgccgccctgactttactccatgagcatataacctctaagcgctcccgaaatgttcccatcgcctcgctggagccggttatggtgctcctggttgagctttctgtggagcagaagaagggaaagctggccaaggatgcgctgtaccagtacaagaacatcgcacaaaacacaaatgtcggcacgatagagcttgttttgaaaaaattcatcgagctcgccgcaggcaaggtcaccgccgctcagcaaaaggccgatgaagtccagtcttctatcgaggccactaactccacaagcgtcgacgacctcgaagctaccgagaccccagagtcgattcttcttgcaactgtttccggtgagcagtcgcgcgaccgtaccgatcgtgccattgtcaccccgtggctgaagtttttgtgggaggcctaccgcactgttctcgacattctccgcaacaatgctcgtcttgagcttctataccagagcactgccatgcaggcctttgaattttgcctgaagtacatcaggaagaccgagttccgccgcctctgcgagcttcttcgcaaccacgttcagactgccgccaagtactcaactcagatgcacgctatcaacctgaacgacccagatactcttcaaagacacttggaaacccgcttccagcagctcaacgtcgctgttgagctcgaactctggcaggaggctttccgcagtgtggaggacatccacaccctgctgaatctgagcaagcgcccgccgaagaacatcatgatggccaactactacgagaagctcacccgtatcttcctcgttggcgagaactacctttttcacgcggccgcttggtcccgttattactctctcctccgtcagtcggctgccgtggttgccagcggccaaggcaagaaggctgataacccacctgctacaccagcagacctccagaaggctgcctcttttgttttgctgtccgctctatccattcccgtgatcagcacgacccgttctcgtggtgcaatggtggattttgatgaagccaagaagaacaagaactcgcgtttgacgcatttgctcaacatgtcccaggcccccacgcgtgctgttcttttcaaggacgccatgtccaagtctttactcaaccaggctcgtcccgagatccgtgacctgtacaacatactcgaagttgatttccatcccctttcaatttgcaagaagatctcgcccattcttgcccagattggtgccgatgaggatatgaagaagtacgtgctgcctctgcagcaggtcattcttactaggctcttccagcagctttctcaggtctacgagactgtagatcttgagttcgtcgagagcctggcccagttccccgagccgttccaggtgactcgcgcaactgtggaaaagttcatcatgaacggcaacaagaagggagatctttcaatccgtatggaccatggtacaggagttctgagcttcgacacggatatcttctcatcctccaaggcgtctcactcaggctctgcggctggttcggcagaggccgagggcggttccgttcagagactccagaggactccctctgagattgttaggtcacagcttgttcgccttggccgggccttgtatacgacatgctactacgtcgatccctcatttaacgagtctcgtgttaaggcccgcgaggctgcattggcgcgggccaaggccggtgctgagaaggaacaccgtgagatcctggcacgaaaggatattatccagaagcgcaaagaggaggcttcggacctgcaggccaaacgcgagaaggagaacgctaagatcaagcggatgcgtgagcaagcactcctggaggcggagcagcaacgcctggcggaggagcagaaggagcgtgaacgcaagcgcaaggagaaggagatgcaggagatccgcaagcaggaggcagagagtctcatcaaggatctcaagattggtcccaatgctctggatgtcagcgccgaagacttggcaaatctcgacacctcgcagattcgcgccatcaaggttgcccagcttgagcgagagaagaatgatatcaacgagaagcttcgtattactggcaagcgtctggaccacctcgaacgtgcgtaccgcaaggaagaggttaagaagcttcacgaggattacgagagccagaagaagcgtgatctggatgcctacagcaagataaaggaagagactttgaaggagtccaagatcaagcacgaggagagtgtggagctgaagcaccgtctcagccgtctgatgcctttctacgaagaattccgcgccaacctgcaggagaggcgtcgggacgagttcgagaagcgccgccgtgacgccgaaagggagctcgagaagcagattgctcaacgcaagaaggagtaccgcgagaagaagttgcgcgagaagaggcagcgggaggaggaggagcgacagctccgggaagccgaggagcgtgctgcaaaggagaaggaggagcagaagaggcgcgaggaggctcgcaaggaggagcttgcacgtgccaaggctcaacgcgaggccgagaggcaagagatggccgagaaggctgctctgcaagcccgcagagaagaggaagccctcgagaggagaaagagggaaaaggagaagttggcctcggcgcccccggcatcggccgcgcctgtcagggcctcggagtctgctggcggcccgcctcgcctcaacttggctggtgcaggtggcaagcccagctggcgtgacagggtcccatcttcaaacgtcggagccgctccctcggagcgttctgagcgtccctcggagcgccctgctcctgcccgaactggtacccccatggagcgcactgattcaaacgatcgtgctggtggtccgccccggcttaaccttgctcgtgctgacggtgccaagcccagctggcgtgaacgtgagcaggccaaggctagcggtggccctgagcgggatcttcctcccagcagggcggcttctggaaggggcccaccgatgcacaggaccgattcgggccgtggagagaacggcagggacgagtcgccggcgccccccagagattcattgacggcttctggagcaccaggcaagtacgtgccgcggtggaagcgtgagaatgccgggaactag

SEQ ID NO: 16 - protein, 1073 aa, Magnaporthe grisae
MPPPPHQKPENVLKRAHELIGVNQAPAALTLLHEHITSKRSRNVPIASLEPVMVLLVELSVEQKKGKLAKDALYQYKNIAQNTNVGTIELVLKKFIELAAGKVTAAQQKADEVQSSIEATNSTSVDDLEATETPESILLATVSGEQSRDRTDRAIVTPWLKFLWEAYRTVLDILRNNARLELLYQSTAMQAFEFCLKYIRKTEFRRLCELLRNHVQTAAKYSTQMHAINLNDPDTLQRHLETRFQQLNVAVELELWQEAFRSVEDIHTLLNLSKRPPKNIMMANYYEKLTRIFLVGENYLFHAAAWSRYYSLLRQSAAVVASGQGKKADNPPATPADLQKAASFVLLSALSIPVISTTRSRGAMVDFDEAKKNKNSRLTHLLNMSQAPTRAVLFKDAMSKSLLNQARPEIRDLYNILEVDFHPLSICKKISPILAQIGADEDMKKYVLPLQQVILTRLFQQLSQVYETVDLEFVESLAQFPEPFQVTRATVEKFIMNGNKKGDLSIRMDHGTGVLSFDTDIFSSSKASHSGSAAGSAEAEGGSVQRLQRTPSEIVRSQLVRLGRALYTTCYYVDPSFNESRVKAREAALARAKAGAEKEHREILARKDIIQKRKEEASDLQAKREKENAKIKRMREQALLEAEQQRLAEEQKERERKRKEKEMQEIRKQEAESLIKDLKIGPNALDVSAEDLANLDTSQIRAIKVAQLEREKNDINEKLRITGKRLDHLERAYRKEEVKKLHEDYESQKKRDLDAYSKIKEETLKESKIKHEESVELKHRLSRLMPFYEEFRANLQERRRDEFEKRRRDAERELEKQIAQRKKEYREKKLREKRQREEEERQLREAEERAAKEKEEQKRREEARKEELARAKAQREAERQEMAEKAALQARREEEALERRKREKEKLASAPPASAAPVRASESAGGPPRLNLAGAGGKPSWRDRVPSSNVGAAPSERSERPSERPAPARTGTPMERTDSNDRAGGPPRLNLARADGAKPSWREREQAKASGGPERDLPPSRAASGRGPPMHRTDSGRGENGRDESPAPPRDSLTASGAPGKYVPRWKRENAGN

SEQ ID NO: 17 - DNA, 2508 bp, Magnaporthe grisae
atggcacctggtagcagtggtgccaatgtcgcagcactgttacgacacgcagtgctataccacctcgacaacagtgcacacgaaaatgcgctctttttcgccgaaagactcgctgctcaggaccctcgatcccccgaatcagcgtttctccttgccctctgccatttccgcctgggagattttctgtcggcgcacgatgccagcaaggacgacttgaagggagcaggccttcggagtttacatatagggcgggcctacatatttgcgcagagctgcttggcactagaaagatatcgagatggggctatcgcactggagaggtgtcgaccgcaatggccgcataaaaccacttttgggaaacacacggcctccacgcgcagcctgatacctgatgctgccgcgctaaactgcctgcttggtaagctctatcaggggcttgacgacaagaacagggctgtatcctgctttgaggacgcactgaagctgaaccctttcatgtgggatgccttcacatcgttgtgtgacatgggtgttcacatcaaggttccaaacatattcaaggtcaccgacaagcttgtgcgggctcttgattcagaagataaacccacgattaacgacaaggaaacatcttcagcagctacattagagccgctgccgagaaagtcagctttgcgttcggcccccgcagacacctcggatcccttcgaccaaccaagagcagtcgccttccaggacagacaggcactcgggaatctggtagccgccgagaccgaagaaaatgagtttctccaaaagatcgcagctgctcgctctaggatggcagcagcttcaggaccaagcagtgcgagtgatctcctagacactcctccagctccttcggctccggtggagataaacgccttgcgtggaggggctcatcctgagcctccgcacgcgcccatgcgcaaaactagggcagcgcatactattgaaccacctccttcggatgccccgccaaggatgggatatcgtggcatcactaaacgaagagcaaatttggaccccaactcagaagccccttcagccacggagcagcccgyttcccagatgctcagaacttcagcgtcatcactgttgggagctgaacagcggaagcggaccatatctgggcatccagtccaatccaggccaggtgttaccgaagaacccggagcaccacagagaagaagtgccaggctcaacatgttcaagcagccctctactgccaagccgaacgctgcagctgctcccattggcaccacatctacgagggaaatgaagaaagccagaccagccatctcgagaatcatgcggccagggagtagcggttctagcgttgggagggttgtgagtgggaaccgaaagccagtggaggaaaataccatggatgttgatcatgtcgagcccccgaagatgagagatgcagttcaaccacctctaggacctgcaagaacaatcgaggcggacggacacagcacagtaagattagaagaaaccttgcggttgttgatggatcttctcaaacgcctgggaacgggatatttggctttgtcgcagtaccagtgcagcgaagctgtgcaagctttcagcacgataccgcgagctcatgtcgacaccccgtgggttttagctcacatcggacgcgctcagtatgaacagaccaagtatgctgaagcagaggcctccttcaagcgcttaagaacattggcaccgaatcggctggaggacatggaggtctattccacagtactttggcacctgaagaaggaaacagaggcatcgtttctggcacacgagcttgttgacatagcgtggcattcaccgcacgcctggtgcgccttgggcaatgcatggtcgctggcatcagatcgcgaacaagcgctgcggtgcttcaagcgtgctacgcagctcgacgcaaaatttgcatatgcctacacacttcaagggcatgagcactttgttagtgaagaatacgataaggcgttgacatcataccggcacgccatagcggcggaccggcgccattacaatgcctactatggcatcggaagagtgtacgagaaacttggcaactatgacaaggcatatacccacttccatgcggcctcagtgattcacccgaccaacgcggtcctgatatgctgcatcggtacggcactggagaagcaaaagcaagttgtacaggccctgcagtttttcacaaaggcgaccgaactagcaccgcgggcagcgcaaacacgcttcatgaaagcgcgcgctcttttggcgttgggacaactacacgaggctcagaaagagctcatgatcctcaaggacctcgcaccggacgaggcgactgtgcatttcctgcttggaaagctctacaaaacacttaacgataagaatacggcggtccatcactttacgattgcactgagtctggatccaaaggtaagccagccgctgcatgtcaatgttgcttttcttgggctacccaacggtgatggctga

SEQ ID NO: 18 - protein, 835 aa, Magnaporthe grisae
MAPGSSGANVAALLRHAVLYHLDNSAHENALFFAERLAAQDPRSPESAFLLALCHFRLGDFLSAHDASKDDLKGAGLRSLHIGRAYIFAQSCLALERYRDGAIALERCRPQWPHKTTFGKHTASTRSLIPDAAALNCLLGKLYQGLDDKNRAVSCFEDALKLNPFMWDAFTSLCDMGVHIKVPNIFKVTDKLVRALDSEDKPTINDKETSSAATLEPLPRKSALRSAPADTSDPFDQPRAVAFQDRQALGNLVAAETEENEFLQKIAAARSRMAAASGPSSASDLLDTPPAPSAPVEINALRGGAHPEPPHAPMRKTRAAHTIEPPPSDAPPRMGYRGITKRRANLDPNSEAPSATEQPVSQMLRTSASSLLGAEQRKRTISGHPVQSRPGVTEEPGAPQRRSARLNMFKQPSTAKPNAAAAPIGTTSTREMKKARPAISRIMRPGSSGSSVGRVVSGNRKPVEENTMDVDHVEPPKMRDAVQPPLGPARTIEADGHSTVRLEETLRLLMDLLKRLGTGYLALSQYQCSEAVQAFSTIPRAHVDTPWVLAHIGRAQYEQTKYAEAEASFKRLRTLAPNRLEDMEVYSTVLWHLKKETEASFLAHELVDIAWHSPHAWCALGNAWSLASDREQALRCFKRATQLDAKFAYAYTLQGHEHFVSEEYDKALTSYRHAIAADRRHYNAYYGIGRVYEKLGNYDKAYTHFHAASVIHPTNAVLICCIGTALEKQKQVVQALQFFTKATELAPRAAQTRFMKARALLALGQLHEAQKELMILKDLAPDEATVHFLLGKLYKTLNDKNTAVHHFTIALSLDPKVSQPLHVNVAFLGLPNGDG

SEQ ID NO: 19 - DNA, 7728 bp, Magnaporthe grisae
atggctccgtcccagtcgctgccagaccatgcgcccagcccctcgcccaatttcacatcccgaaccgtgacgcgacttgacgaggaaaacgaagagtacgatagctatgaagacttgggcaagacactaaggccgcttgcctttgaatttcccccgaaccgccgcctagccacccattcacgcgactcatccattgaaaagatcactgttcagctaccactctcaccgccacaaacgcaacaagtcgcagggtccacctcttcggcggcctccccggttgtctccccacgagcccatgcttctgccgtgcgatcggctaccggtattgggggcgtaatcgagcgggccattgacccgaaagctgctgcatacggtcaccaccgtcagacctcgatagtccacggcatacaacattctaggaatggaagccacgccagctctgtatcaagtccactgagcccccagattattgccgctgcgggagcatccttagctttagacccgcccgacatgcacgcgtatgccgtttcgacgtcagatatcgactccccgttgggttcgaggcccccgacggccgcgtcgaccgggtccaccctagtgaacagtcccgttggcaccgagagatcatcggctgccacagatactaccgctcatgcgccaacgccaagacgaatgcacagcggcaaggccaggagggaccacacgcaaaatccgtcgcactcgtcaaggcaccacaaggaggagcaaaagactgtaggggggtacgccatgcatgtgctgttcacttctttcatcgcgcacgcagaagagaaactgaacgaatgtatcacgccgccgtccgagcccgagccccaggtcgaacaaatatgcggacctggggccgacgaatcattcgatcggctgatcgttgcattgggccatatcgccagacaaaagccgaaacctttgatcgactcgatgatgttgtggaggaagagcaaaagcgatgccgcgagtgacgcgcgcaagcagctgcaaatgtccaaatccgtaccgcccagcggtcctctcctgaggagaaacacagagccactgcagttgatgtcaggccctaatcctcaagaccagaacggttccatatcgccatcgcctctcgcagcgaagcaggagtatgttgtgcaaacagaaagacggtcaagcgtctccacctatctgctatgccgtgtcctcctcgaggtcatcagccaaagcagtttgagtctgatcactcctgaaatggaagacaagctggaagatattatctttagtcaactcaaagtagccgacccggagcaacttatagaatctcctctcaagcttgccaactggaatattttcgcccaacttctcggcgtcatgagcgaaatcaacttcacaagcgtgacaaaccgcttcattcaagatctggaacgttccctgcaggagcttggatcgagaggatccgccttgccctcgcgagaggagacggagggaaggatagagctcgttcttggggggatgaagcatttgaggcttgcgttgacgcctgacgacgcgtgggaaaggtcgtgcgaatttatgagcgcacttggcaggctgtttgcaaggtcacatggccaaaagatcaagtcgtccttctgccaagtcttggagatgctgctgctccccatcgccgggaaggcaacaaacagccagttcatgaaaccccaatgggctgaagtcttgagcaatgctggccctcgacttgcgcaaatgtttgttaagccacgccattggtactgctctttccccttgactgcaacgatgctctgtgtctcgtcgccagagacgttctctagccagtggcttcagttggtatatccgctgcaaccgaagctcaaagatcgattctccaagccgctctgtctgcaagtcgtgtccagacttgtttggacatatctctaccgcaccaacgaatccccagcttcaaccgtacgcaagttggatgaggtcctcaagctggtgctcccaactgcaaaacgcactatcaactctgccgacccaactgtgtctgagcctttgatacaaatcatcagaatcatcgggttcaaactacccgagttctgtttcaaaacaataatatttccgctgataaacgcagaccttttcgcaaccaacagggagctcaaagtggatagcttggaaccagacaaggttgttattggaatccgagcatttttggccgtgatggcggatctcgagaagggtgaccagggaaggccaccgttcccccaacagtaccctataacatctgtgcctgaacgcgcctcacaaacaccgatagctaacgggtcgtcaagcccgccgacccctggaggacccttagatggagtggaggacgagggactcgcgcgccgcgtgttgacgtctactctcagcgagtctgtgaaggagtactacaccaggttttgccaaatattgggcaagattactataatgtgtgacaacacctttggaggccaggccgccctcgacgaaaagttcaactcgcctactcccaaaacacctatcgccgacaccttcaactttcgccgcgatgagcaccaaaacccgacagatcagaaacaggccttctacgagctcctgcacgtggccgtccaggcattaccccgctgcctatctcctgacattcccttcaactcactgattaacctgctgtgtaccggaactgcccacgtacaatcaaacattgcagagtcatcggccctgtccctgaaggccatagctcgccagtcacatgcccaacaagtcacgatggggttctcccgctttatcttcaatttcgacgatcgatactctaccatgtctgacggcggcatgctgggggctgggcacattgagaatactctgagactatacgtcgagctgctgcatatatggatcgaggagattagacataagaccaaggaagcaacgggtgcagttggggacacaaacgcctccgataagaggggcatgaaattagacttgtccagcatatgggctgaagttgatcaagctgaggcacatggactttttttcctctgctcccaatcgcgcagagtccggtatttcgccataacggtgcttcgtctcatcaaggagttcgacatggccctcgggaaagcagaaagcgatgatgagaaggaagccgtgagattgatagatgtcctggagaaggactacgtacaggtcatgacttttaacgatgatcatctgtcagtggcagagcgaagcagattgcaaagagggatgcaagacaacaacagccaaggcctgattacgctttgtgccagcgatgtttcctacgacaccactctctggttcaaggtgtttccgcatctcatcagggtagcttatgaccgatgccctttcaccattacgatcggccgggacttgatttgcaacaggatattgcagatgtacaaagcgataaccatcatttctgagccgtccagagggctctactacgggtcggatcccggaagcgcccgtctgacggggaggacgccaacgacacagcctgagctgctggtcgagcagtggaagctctatcttgtctttgcgtgcacaacaatggcagatcctggcagcccccaacagccgaagcagccaccgcctccccaggcagcccagcacggccgaaagggctccaacaacaagtctctatcggcagacaagattgtcacggctcgcactctcttcaaatacctgaacccactcttgtcggtgagctctgcgtctgtcagggaagctgtcgttgtggcgatggggtcaatcaacattaatatctaccgcacgctcctggaagagcttcaggggcacgtatcgcgatgcaacgacgaagccagggctcgtattcaccagcgtaccaatagcagccctcgtcgcaaccgcaggatggatttgcttaggactgaaataactcatgtttacaagctcacctctcacttcctcaaggatccttcggtaatacaggatgactggatacttagtaacctggtggcgtattccaaggacttgaaactgttcttgatggatggagaagttcagatggactgggagtttcaaaaattgcggcgccactactgtggcttggttgaggagatcttcgaagggatcaaaagaaccaaggatccgtcccgctggatgactttcgaggctcgcaaatctgcgtttgcactcatggaagattggtgtgggttttcgcccaaccacaaccagatccgacatcgtgaagatacaatgcggcaatccgttatagagcaacagtctgctggggagcgcggcacactgactgccgcaatggaaatagagaagagaaatctcaggactgcagcactgagcgcgatggcggccctgtgcggcggccctataagtgttactaccgaaagtggcgtgtcccttcagttcgacctcaggcggatgctcaactggatcgagtcgatattcactaccggcaatgaccgcatgaaggtcactggcaggcgagccctcaaaaaccttctcgtccacaaccaggagtacccgtacctgctggaacactgcatcatgcgttgctacctggcaaatgtccccaaggtgctagaaagctacttcagcgtcagcactgaggtgcttctggaatatcctgagtatccagcgtctttctggaaactgctgcccctgtgcctcttcactcttgggaacgaccagagcgatatacggataaaatcagctcgcatcctcagggctctcgaggagcggcagcaaccaccgcggtcctccaaaatccaagactttgatatcagcatctctgataagaccaaggcagtctacaagcttgcacagtataagatctcggagcgtctctctaagcagtatacggagctggcattttacttcttctcgcagctttcactatatttcaaagacctcgagtctggtgcgcaaaggaacatggttgctgtcatcctaccgtggatccagtcaacagaactgaaggtcgaccccaacggtggcccggtcgctcagtcatatatgctcttggccaacctactggaaatcacaatcaaggccagctctgctctccataacgaggtgcaagctctctggcaagcgctcgcgaccggcccccatcctggcaatgtacgactcgttcttgacttcataatggcgctctgcttggagcgccgggagcaaaactttgttgaatatgccaagcagatcgttgtctttctcgccagctccaacagcaaccctggacagaaggttgtcgagttcctgctgtcattcatcacgccaaaaaacatggtgccgaacgaaaagcgggacaccccccctccacctccagacgttggacttctcccatactgcgccgacttgtccgaggctctgcctgttggtacaaaacaagctggtttctcgaccggtcaactttcgatgatactactcgtagacctaatggtttcacctgtcaaggtggtgccggataatgtgcccgtgctgctccaggtggtgattgttctttgggaccactacacgcccttggtccatgagcaggcccgcgagatgctcgttcatctaatccacgagctcgtcatatcaaagctagacgatgcgacccctcagtcgaaaaagaaggccattgaggatctcattgatctgattcgccaacatgacaagcttgtaatctggaactatgaggatagtaacggcaaggccgaggacgatgggagcaacgtcccacccagcatggagtatctcgccgccgaagtagtcaacacatttgaggttacctacccaggcatcaaagaccagtgggctaggctgtcgttgatctgggcgacttcctgcccggttagacatctcgcctgccgctcgttccaagtcttcaggtgtatacagacgtccgttgaccaatacatgctgggagacatgctcgtgaggctgtccaacaccattgccgacgaggatcccgagattcaaacattttccatggagatccttacaactttgcagaccataatcgcgagtcttgatgtcgacaagctcctcacctttcctcaaatattctggaccacctgtgcctgccttgaatcgatcaacgaacaagagttccttggcgccgtcaagatgctcaatgagtacttggacaaggtagacatgacttctcctagcccactcctttacaaaggcctacgatctgcggtttgccttgatgctacattagcaactctcaatcgactagtgcccctgccgagcgaccccttgataggagacgatagccgcgtctttttcaccattctcgccaacctgccgcgattcttgcagacaatggaccagcctcggcccctgagtgagcctgtcagcaagaccatcggggctcttctagatgttgccatcgaagagggacattcacccgtggctctcgttctgaatggcttcctgtccggcaactatcggaatggcaccgagctcgtacatggcgtctttgcggcctttaaggatacattttcgacgcagctcgatttcaaaatgattactatgattatgggcttcctcacaaatcgcacaccctgggtcacgtccaagacgctgcaaattctcaaggtcatcatctcggagattgatatgaagcgtcctgacattatagggcatggctcggacctgctttctcctcttctgaggctgttgcagaccgagtactgcatggaagctctcggcgtactggacaacataatgaacatgtcgggctcgacaatggacaaacagcacttgcgcatgagtatgacgcggtcgacattcaaggctatcaggaaggaatacgagcgagtgcagagcctgtttggcatacccgaggaatctggctgggcgattcctatgccagccaagaagacagaaaccacccgggcgaacgtccatgccgccttttacatgtgccagggagccgagggtatcgttaccgatgtcatgcccacccccgaagtcgagttccacgccgacgaatttccctacggctacttcccaacatcctatgaaaggaccgagacaatgttgtcggacgaggctcgtggggacggcaacggaggtgacgtggtcacgaagctagatagcctcgatgacttctttgacgatcttagtatgagcccacccagcgaagcacactcatcgaatactataaccgagtttatcccggataacaactatgacatggaggcccagctgtacgatgagcaggtccttcccatcctccaccaagcttcgactgccagctcttttcagaacggcttcgtcgataggcctgcgccattgtcgagagacggttactctaacacaatgacacctggagcgttcagtttcgaccaggaactgacatcgaccacgcgcccagggctgcactcccggagtgtgacctcgccgtcggctccagcatcataccagcctcatctgggagaggccatcgcatctgatgatgagctcttctcggacgacgagcgctccaacgccggtggcgcaccgcccgagggctctttcttcctcgagaatatggtcaagccccttactcaaagcactcggactcgcattagacgcttgaccggcaacaggtcgaaggatgaacgacagcatctagatatttcccgtcccgaccgcccaggccctcctcaggtacccaagcttcccagttcatacctgcccaaggggtccccgcctggtagtggggacatgctttga

SEQ ID NO: 20 - protein, 2575 aa, Magnaporthe grisae
MAPSQSLPDHAPSPSPNFTSRTVTRLDEENEEYDSYEDLGKTLRPLAFEFPPNRRLATHSRDSSIEKITVQLPLSPPQTQQVAGSTSSAASPVVSPRAHASAVRSATGIGGVIERAIDPKAAAYGHHRQTSIVHGIQHSRNGSHASSVSSPLSPQIIAAAGASLALDPPDMHAYAVSTSDIDSPLGSRPPTAASTGSTLVNSPVGTERSSAATDTTAHAPTPRRMHSGKARRDHTQNPSHSSRHHKEEQKTVGGYAMHVLFTSFIAHAEEKLNECITPPSEPEPQVEQICGPGADESFDRLIVALGHIARQKPKPLIDSMMLWRKSKSDAASDARKQLQMSKSVPPSGPLLRRNTEPLQLMSGPNPQDQNGSISPSPLAAKQEYVVQTERRSSVSTYLLCRVLLEVISQSSLSLITPEMEDKLEDIIFSQLKVADPEQLIESPLKLANWNIFAQLLGVMSEINFTSVTNRFIQDLERSLQELGSRGSALPSREETEGRIELVLGGMKHLRLALTPDDAWERSCEFMSALGRLFARSHGQKIKSSFCQVLEMLLLPIAGKATNSQFMKPQWAEVLSNAGPRLAQMFVKPRHWYCSFPLTATMLCVSSPETFSSQWLQLVYPLQPKLKDRFSKPLCLQVVSRLVWTYLYRTNESPASTVRKLDEVLKLVLPTAKRTINSADPTVSEPLIQIIRIIGFKLPEFCFKTIIFPLINADLFATNRELKVDSLEPDKVVIGIRAFLAVMADLEKGDQGRPPFPQQYPITSVPERASQTPIANGSSSPPTPGGPLDGVEDEGLARRVLTSTLSESVKEYYTRFCQILGKITIMCDNTFGGQAALDEKFNSPTPKTPIADTFNFRRDEHQNPTDQKQAFYELLHVAVQALPRCLSPDIPFNSLINLLCTGTAHVQSNIAESSALSLKAIARQSHAQQVTMGFSRFIFNFDDRYSTMSDGGMLGAGHIENTLRLYVELLHIWIEEIRHKTKEATGAVGDTNASDKRGMKLDLSSIWAEVDQAEAHGLFFLCSQSRRVRYFAITVLRLIKEFDMALGKAESDDEKEAVRLIDVLEKDYVQVMTFNDDHLSVAERSRLQRGMQDNNSQGLITLCASDVSYDTTLWFKVFPHLIRVAYDRCPFTITIGRDLICNRILQMYKAITIISEPSRGLYYGSDPGSARLTGRTPTTQPELLVEQWKLYLVFACTTMADPGSPQQPKQPPPPQAAQHGRKGSNNKSLSADKIVTARTLFKYLNPLLSVSSASVREAVVVAMGSININIYRTLLEELQGHVSRCNDEARARIHQRTNSSPRRNRRMDLLRTEITHVYKLTSHFLKDPSVIQDDWILSNLVAYSKDLKLFLMDGEVQMDWEFQKLRRHYCGLVEEIFEGIKRTKDPSRWMTFEARKSAFALMEDWCGFSPNHNQIRHREDTMRQSVIEQQSAGERGTLTAAMEIEKRNLRTAALSAMAALCGGPISVTTESGVSLQFDLRRMLNWIESIFTTGNDRMKVTGRRALKNLLVHNQEYPYLLEHCIMRCYLANVPKVLESYFSVSTEVLLEYPEYPASFWKLLPLCLFTLGNDQSDIRIKSARILRALEERQQPPRSSKIQDFDISISDKTKAVYKLAQYKISERLSKQYTELAFYFFSQLSLYFKDLESGAQRNMVAVILPWIQSTELKVDPNGGPVAQSYMLLANLLEITIKASSALHNEVQALWQALATGPHPGNVRLVLDFIMALCLERREQNFVEYAKQIVVFLASSNSNPGQKVVEFLLSFITPKNMVPNEKRDTPPPPPDVGLLPYCADLSEALPVGTKQAGFSTGQLSMILLVDLMVSPVKVVPDNVPVLLQVVIVLWDHYTPLVHEQAREMLVHLIHELVISKLDDATPQSKKKAIEDLIDLIRQHDKLVIWNYEDSNGKAEDDGSNVPPSMEYLAAEVVNTFEVTYPGIKDQWARLSLIWATSCPVRHLACRSFQVFRCIQTSVDQYMLGDMLVRLSNTIADEDPEIQTFSMEILTTLQTIIASLDVDKLLTFPQIFWTTCACLESINEQEFLGAVKMLNEYLDKVDMTSPSPLLYKGLRSAVCLDATLATLNRLVPLPSDPLIGDDSRVFFTILANLPRFLQTMDQPRPLSEPVSKTIGALLDVAIEEGHSPVALVLNGFLSGNYRNGTELVHGVFAAFKDTFSTQLDFKMITMIMGFLTNRTPWVTSKTLQILKVIISEIDMKRPDIIGHGSDLLSPLLRLLQTEYCMEALGVLDNIMNMSGSTMDKQHLRMSMTRSTFKAIRKEYERVQSLFGIPEESGWAIPMPAKKTETTRANVHAAFYMCQGAEGIVTDVMPTPEVEFHADEFPYGYFPTSYERTETMLSDEARGDGNGGDVVTKLDSLDDFFDDLSMSPPSEAHSSNTITEFIPDNNYDMEAQLYDEQVLPILHQASTASSFQNGFVDRPAPLSRDGYSNTMTPGAFSFDQELTSTTRPGLHSRSVTSPSAPASYQPHLGEAIASDDELFSDDERSNAGGAPPEGSFFLENMVKPLTQSTRTRIRRLTGNRSKDERQHLDISRPDRPGPPQVPKLPSSYLPKGSPPGSGDML

SEQ ID NO: 21 - DNA, 4999 bp, Magnaporthe grisae
atgtccgaagcctatcttttagagacactgcagtccttctatggcgatctaatcgcaataggcgaggggcgcctcaatggcccgtctctggagggagacgagctgacggctctcctcgaaaacttcaagaactttcttgaggagccaccaaagcgagacgctagccgaaaacaacttgagtccggcaagattagcgtgggagacgtagaatactcgatcaacaaggagttccaggaatatagcatacaactcgcagacgaggtaaacctggatgaggtcgaggcggccaagctgctcctcgaggcacaagatagccagatcctcctgggaaggtcgctagtcgagtgcgcgctcattcggttccaccaacgacgaaaatacctcctagattgtatacgactatgtatcgagcttgcgaatgacgacgagaacgaatcgatcaaggcggtcttcgaagaaattgttgcacgatatgtttttgacctgccattgccaggtgctccggccgcggcggttccgaaggaaaagaaagtagtgccacggtgtatggcagcaatggccaagatcaaagactggctcgaaaaactggccaacaagatcatgctggcaagaatgcacagcggcacggctcctcctgagatcgagaccatcgagttttgccgcttgagtctagtgcagcaacacgagaacttggccgtcatcctatgcgctgcggttgagcaacgtcatgcagaacgcacaaactttgaagagttcatccaactgctgaagaaggccgataaatacgaccacctcttagtgcatcttttccccgtcattggagcctatattcgtctgtatggatcgactgagggctggggggatctggttattgccaggtctttgaaccaaaaaattgtcaacgacgagacgtcttggtccttgccgtttctgtatgccgctgttaaggtctggtggattgcagagtacagcggcttctacgtcgagggtcctgtttcggatcccagcattgacattgacaaagaggataaggagagaaataagcagttcaccgacgctctcaaggagggagcattcgacttcatgttgtcacttgcaggggatgttgctgcccctgaatggcaagacccctctcgtattggaatcaggcaatggctccagcgaaagtcaccacaactgatgactgattcaacgccattctccgactacttccacacgtgcttgatgaaccagcttgaagattttgtggatgcttttatatcaaatcttcccgatgttcttcggaaacttaggaccgaggaggacgaacaacggcagcttagccagcaccatgaacaagacttggatctggaaagattcctggtcatcatctcttacgtctttgaaagacggcccgacgcagctgacgtgttctggtcggactctgaaagcaacttggcaggtttcatgcagtgggcatccaggagagcatccacgccgctcgtgtgtgctttctgcgagatgctgcagtccatcactgagaatgaacagtacgcacttgctgctcaccagttcttgttggaggacagcaatgccggagggaaaatgagaagatcacagtccttgacatgggctcagattttcaaagagttgcactacttcaccaagaaaattcgtggtgaaatctctagcccacagcaaattcacgaataccgaacgcaaaagccaggcgaggacctagcagaaacggaaccggagtcggctatgctgctggagtgctatctccgattgatcgcccgacttggaagtcagagcacagcggcaagggagttcctactcaggaaccaagacttccccttggtagatgtgattctgcagctgaacagctgccacatacctcctaggctgcgtgcctgtggcttctatgccattgcggcactagtcaggcgcaaagaacaagacgacagcaataccatgtggctttgcatagacgcctttgttagtggcggctttcaagccgcgagcaactcccgtggattgattaagggacaaagccacagctcagccggcgttgttgatagggtattggacgagctgagcaacggtttcgaggaaccaagtgcttttatcaacctgatcaacgctttagtcgcgccagcagatcaagcaagtctcctgcgagatgcccttcctttccccgagaaccttgggtctagcttacgaatgccggggattgagccatacgttgactttgttgtgggacatgtcttcagcctcaagtcaaaagagctccaggatgtttcgcagctgagagttctgcgagtgagctgtttggagtttatcttgctgtgcctaaacacgttcaacgaagatcttatcattcttggtaatcagaccaatgtctctgtggacttgatcattgccacatcagacctggccacatatgtccgccttcacccattcgctcgggtgatggaatggatgttcaacggccaggttgtagatgccatatttgaaacgatacaccaacagtccagcgatatcggaagcgtttcgcccgattcgcccttgatattgggcattatacgagctgttgaggtggtgtcgaaagttttggagcttcaggacacatatgttgatcttgtgcggcaagtcataaaacagcacacaggacaacgccatagacatgtgcctcacgcttcctacgcctccttcgaagaagggtttgctcatcacctcgaggtcgtcgcagatctcggccgatattgcggcctcggtcacccagagctgaccatggtctgcttaaagcttctggcacggatttccacttcatcgaaactgatatcggcgtggaacaccgagccaggtagacagtcccaccgcaacaaggcggtagtggctctagaaaaagatggggaagcggattctatttccggatccctcattgccgagcttatcgtgccccttgacctggctcgagaggctgactctccaaactacctaatcaagacttacattctagacttcctctacgcatgtttacgagcatctccagaccaaccaactatcgcccatcttctactcggcttcaagtgcggcgtgagccatttgaaagtcgagcccagaggccagttcgaggaaaggacgtcgctatttcacaatcttctcagggtattgctggagactccttttggagacgaggagctaggaatgaggacatggcttgtggcattaaagcgcaagttatggggatactgcagattctttggagttctcctctgtcctcggccattgtcttggaagaactccggagcaacgacgttctattccatattctgctccgcgaggagtcaatacagctgatctgatgtgggatggagtgagcatggaggaacgcggattcctactctctgacgcagccgtgggtttttcggagttcctggctacgaggcaacttaccttcgattatctggccatcgagttatgcagcgtcacccagaggcgcctccccagcttgaaacgccgtatctatgacgcccttaacggacaggtcactactgccaattcggacagccctcaatccatacccaccatcttcgatttgtacgattttatgcctgcggacgggcaatgggagatccctctacctgagttcacccatttcaaaggcgaagaattcagtatgtgcctggaaggagcacatgactctgtgctcatgtacaacatggagcgggtaaaacaggtgattgcattgaagaggaggcaggatgctcaaaatggtcagatagctacggctgccgacctcgcttccgtggaccgggagcaggttattcttgaggaatacttggtctaccacaaccgccaagcagcagtcagttctgagcgacggaaagtgctcaaagcctgggttaatctgctcatggtgatgttcgaggcgagcgatcaccagggctcagcgaaggttgctttccttttacaagcattgcagacgatattaccaactcttgagtctttcggatccgaacgtccgggtgaggcatttgagctggcgaaactggcaaaagttctcctcttcaagctcgacatagccgctccagacgcagaggacaaggacgcacataccgtgggcaacctcatcagcgagaagctcttccagttgtttgaggtttgcctgtacgccataggtaggcgaacgggcagtgcggaacttcgatccacgtactatgccatctgctaccggtatctgataggtatcattgacgatggaagagatttcgtgcctggccgcaggaaagcgatcaaggctgttcaggtctacggcgagcgcctgttgaccatcgtctgcgacgatgcatttggcggcgatgcaacgtgccaaacttctgcgttgatcttgctaggcgctttgacgaacctgggtcgacgagaggacgacggtcaagtggtggaggctctcaatcgcctgaactttattggcgtcctcgttgactctttgaagacaatcctcgatgatgtgactgcggcccgtaaagcaggaaactcggaccagcaagaatcttactcgcacgcaaaattggcgcttctccttcagctctgccaaacccgcgatggagcaaagtatgtgctgcaggctaacctcctgcgcgcaattgaggtctctgggctttttgcggcagacccagagctccagattgatcggagcgacactaaagccttggcggaccattatgacctcctaataagggtgatgcgtgtcatcggtgcggcaatactgagtcgcggcgcgcacaacgtcccgcaaggtcgccggttcctgaccgagcaccgcatgcttgtaatgcacgtcctcaagcgatccgctggcatcgcagccgtcgaccagaagctggaggcgctagttgttggactcgcggattccttcatggtgctgattactgccacagagtttttggagtttgaggatactcaagggcggggtccgcaacagcaaaagaagactggcccagtcctgtttcattga

SEQ ID NO: 22 - protein, 1666 aa, Magnaporthe grisae
MSEAYLLETLQSFYGDLIAIGEGRLNGPSLEGDELTALLENFKNFLEEPPKRDASRKQLESGKISVGDVEYSINKEFQEYSIQLADEVNLDEVEAAKLLLEAQDSQILLGRSLVECALIRFHQRRKYLLDCIRLCIELANDDENESIKAVFEEIVARYVFDLPLPGAPAAAVPKEKKVVPRCMAAMAKIKDWLEKLANKIMLARMHSGTAPPEIETIEFCRLSLVQQHENLAVILCAAVEQRHAERTNFEEFIQLLKKADKYDHLLVHLFPVIGAYIRLYGSTEGWGDLVIARSLNQKIVNDETSWSLPFLYAAVKVWWIAEYSGFYVEGPVSDPSIDIDKEDKERNKQFTDALKEGAFDFMLSLAGDVAAPEWQDPSRIGIRQWLQRKSPQLMTDSTPFSDYFHTCLMNQLEDFVDAFISNLPDVLRKLRTEEDEQRQLSQHHEQDLDLERFLVIISYVFERRPDAADVFWSDSESNLAGFMQWASRRASTPLVCAFCEMLQSITENEQYALAAHQFLLEDSNAGGKMRRSQSLTWAQIFKELHYFTKKIRGEISSPQQIHEYRTQKPGEDLAETEPESAMLLECYLRLIARLGSQSTAAREFLLRNQDFPLVDVILQLNSCHIPPRLRACGFYAIAALVRRKEQDDSNTMWLCIDAFVSGGFQAASNSRGLIKGQSHSSAGVVDRVLDELSNGFEEPSAFINLINALVAPADQASLLRDALPFPENLGSSLRMPGIEPYVDFVVGHVFSLKSKELQDVSQLRVLRVSCLEFILLCLNTFNEDLIILGNQTNVSVDLIIATSDLATYVRLHPFARVMEWMFNGQVVDAIFETIHQQSSDIGSVSPDSPLILGIIRAVEVVSKVLELQDTYVDLVRQVIKQHTGQRHRHVPHASYASFEEGFAHHLEVVADLGRYCGLGHPELTMVCLKLLARISTSSKLISAWNTEPGRQSHRNKAVVALEKDGEADSISGSLIAELIVPLDLAREADSPNYLIKTYILDFLYACLRASPDQPTIAHLLLGFKCGVSHLKVEPRGQFEERTSLFHNLLRVLLETPFGDEELGMRTWLVALKRKVMGILQILWSSPLSSAIVLEELRSNDVLFHILLREESIQPDLMWDGVSMEERGFLLSDAAVGFSEFLATRQLTFDYLAIELCSVTQRRLPSLKRRIYDALNGQVTTANSDSPQSIPTIFDLYDFMPADGQWEIPLPEFTHFKGEEFSMCLEGAHDSVLMYNMERVKQVIALKRRQDAQNGQIATAADLASVDREQVILEEYLVYHNRQAAVSSERRKVLKAWVNLLMVMFEASDHQGSAKVAFLLQALQTILPTLESFGSERPGEAFELAKLAKVLLFKLDIAAPDAEDKDAHTVGNLISEKLFQLFEVCLYAIGRRTGSAELRSTYYAICYRYLIGIIDDGRDFVPGRRKAIKAVQVYGERLLTIVCDDAFGGDATCQTSALILLGALTNLGRREDDGQVVEALNRLNFIGVLVDSLKTILDDVTAARKAGNSDQQESYSHAKLALLLQLCQTRDGAKYVLQANLLRAIEVSGLFAADPELQIDRSDTKALADHYDLLIRVMRVIGAAILSRGAHNVPQGRRFLTEHRMLVMHVLKRSAGIAAVDQKLEALVVGLADSFMVLITATEFLEFEDTQGRGPQQQKKTGPVLFH

SEQ ID NO: 23 - DNA, 4317 bp, Magnaporthe grisae
atgagcgcggatcctctgttacccatcgctccggcgagggtaaaggccctggtcctccccgtcggccaaatcagacgccagcgcttcgcctcctttctggataggctggccgccgaacaggtggttcagctgcgcgacatcagcccagatggccggccgaacaggaacatgttctcgcccctggcgttccccgacggtgccatgttctacgagctcacgacccactacccgcacccctcctacttgaccctcacgcctttcgacctctaccgcgagccctttgtcgtcattgctgttgctgacgcttccgagatcgaccgccatgccctcagcaagaggcagtcaggagggggtcggaccaccactgaaagaaacattaggggcttgtaccaggacctggaggacctacgcgaccagttcccaaaggtactcgtgcacaggctgttgctttttgactacgtggagaatcccgacgaacacgttccgatcccagaagacatcacgaccataccgccaccccaggactgcaagagaacaaccatgaggacggtcatgtgtgacatagcgtcacagctcctggccgagatgacctcaatggcaaagcaattcgaggcactctcttatgttgattccccaggccagatacccacaggacagccgaatggccaggaccctatgcacgccagacggaactcgcagttctcgttgcctggggggaccaacggtggacgttcgagctcagctgccgcaaacaaccgcatgtctatgcctgtgctaccaaaaggttcaggctttggatccgccggttcgacgccgatcaggccatctacgccggtaaagagcgggctctcaaatacgccgaatctggacgatggctcatcagagtttagctcgggccctccgacgccggagcaacccaatgcagtacggcctggtaccaatgagaactttaggacagtcagtcaggacaggatatcagtgcaagggtttgggtccggcgggctcaacgagaggtggagaagcaaaggcaaaggcagggtgaccatcatcctggggtcgttatacctgcaggcggggcgatggccagatgctctgaaccacctcaccgagggcgctaccgtggccaggtcgattaacgatcacgtttggcacggcaaggctctggagctgatcgtgatatgcttactgctactgggctgggctggtgttgagtttcaggtgccctcggtgctattggcgccgacctcggaaaagacttctgccagcgcagcagcggccatggccgcagatgagaagaacgcaagtccaacccagccgcggtggtttagaaacttgcaggtcatcctgcctgacctgctagaccgcataattgctctatattcaaggatatcagctgagcatctaccccccttgccaatggccgaggctatcatcagatgctccaggaccttgactgggcttcacctgactgatggctgtctcgaagccgacacacttgggctcttggttctggggcgggcgccgaccaaagtcttgagctcatcacctcggctgaccgtgactccgtcccgtacactcatcgtcaacatgatgttcaaggcattcccaaactcatcaaccgagatgctgagcgcggtcgatcgaatcgcgattttatcaggcatcgcatctgtccttggcatgctaggctatcagaggaaaaaggccatggtcatccgggagcttgtctcagtattgatagggggcctcgttgaagctaggacgcgtggtgcggctgaggtcggcattcaccctgctgcagggctcgctgcattgaatggcgtcagcggccacacgacaggagctgcagccctggaccttggagagggcgacattgaagaatcgatcgacgtttttctaggtctcttgctcagaacatatggcgtggtctcattcgaaatggatacactcgtatcaccaaccaaagatatggaaactgctcatactgacgacggcgcagtcgttaggatacaaaaacaggcagcggcaagattctttggtatacctgcgctcaagctcaatatcctcagagcctgcataaacttctctgaggcactgccagactttaacggggtgctgaagtattcgagtgatctgctgcggactgcaggcagcggtcttgcacctgggccgcggcgtgaggatgccgcgcccataatatctagggatgaacaggtgcgcctcataaccaacatactgaaaacatctagcctctcccagcgtcttggcatgggtgaaatgctggccgatttttgggacgaattcttccttaggggtgtcaagctcgagcctctgccccggacgcgggcaacgattgagcataaaaagagtgagcttgcaggtgcatcgacggcgcgcgaatcccaggacgttgatcctctaattcacaacccgttcctgaagccgcccgacaaggcagcagtagaaagtaccctggttgcgttcgagcccgcgactttcaaattgactttacaaaatccgtatgaaatcgaggttgaaattgaaagcgtgcggttagacacggaaggggtcgagtttgaatcctctgtcgacagcgccctcattggcccatatcgcacgcagatacttcgtctagtcggcataccgaaggctgcggggtctctaaagattaccggcgccatcatcaaagtcaggggttgccgagagaggaggtttcctatattcccgagcccttggtccccagaagaccaaccaaaagtcaaagctattgggctggcagctttggaacagcatgttttggagccggcatcccaagcccccaagactgaccacatctcgctcaacgtcatagatgagcagccagttgtggttgtcaagtcgacttcgttggcccagtcttcggttatgatcctagagggtgaaagtcaagtattctcagtcacactgcagaacctgtccaagacaaccgcggcggactttttgttgttttcgttccaggattcgacgcaggagcctttgcaagctgcattaagcaagaggaatgccacccctcaggagctatacgagtacgagctgatattggcgcgaaagcaagctttgcgtctcaagcccagagcggaccacaagaggtatattggtcccggagaagaggcgacgtttgatttccagatcctgggcaaaccggggcttaccggcggtattatacaagtggattatgcgcaccttggtgtaccaccggaggatgtacctgccaagtttcacacgcgccaggtggccttgcagcttaccattacggtcaacgcgagtgtcgagttgacgagggttgacgtactgcctcttcacgaaggtatccctcggccactgcttgagacggccttccgccgtggagatggtgccagttccctaaaggaaattcaagagaaagtctcgtcagacgattattgcctgctattacttgatctgagaaatgcatggcccagctacatgcaagtcgagctgagcactgaggacggcgctctaatagaagagacgatattgccagggtacacgtcgcgggtcatggtattactcaagcgggtttacttggaagatccacatgcagcagtcccaaccttgaacccagcacggcagcgtcaatttgttgtaagcacgacaatatcaccagaaacggaaagagccaaccgagaggcgttctggtacagagaggagttgctcaaccggatcaaggggtcatggcgggcgacttctggtaccaataggcacggcgccatcgaattgcgcagcatacggctgagcccgcgtatgatcgacgcggtcaagattgaggacgttgacattgacatctcagttgcgtcgcaaaatcccggcgacgatgagagcaagaacgtcttgtatgttgacgaattctcgcgcctcaacgtgcacatcatcaaccggtccgcgaagcccatttacccgacgctgcggctcatgccggccctctgccaccgaccgctcaacgtggcgctggactacacgagaaagtttggttggatcgggacactgcagaagtcgctgccgctattagaggcgcacggggagacgaacgtcgtcatgaccgtggccgcgctctgcagaggtcagtttgaggtcacggcatcggtggaggagacgcaactctggcgggacgagggagcgacggccaagggcagcgatgaaggcggcagaccaagatcagatacgcagacgctgatggacgcggttttgggggccagagagaggaggatctggcacactcgaaagcccttcactgtgacagctctggatagagacggatga

SEQ ID NO: 24 - protein, 1438 aa, Magnaporthe grisae
MSADPLLPIAPARVKALVLPVGQIRRQRFASFLDRLAAEQVVQLRDISPDGRPNRNMFSPLAFPDGAMFYELTTHYPHPSYLTLTPFDLYREPFVVIAVADASEIDRHALSKRQSGGGRTTTERNIRGLYQDLEDLRDQFPKVLVHRLLLFDYVENPDEHVPIPEDITTIPPPQDCKRTTMRTVMCDIASQLLAEMTSMAKQFEALSYVDSPGQIPTGQPNGQDPMHARRNSQFSLPGGTNGGRSSSAAANNRMSMPVLPKGSGFGSAGSTPIRPSTPVKSGLSNTPNLDDGSSEFSSGPPTPEQPNAVRPGTNENFRTVSQDRISVQGFGSGGLNERWRSKGKGRVTIILGSLYLQAGRWPDALNHLTEGATVARSINDHVWHGKALELIVICLLLLGWAGVEFQVPSVLLAPTSEKTSASAAAAMAADEKNASPTQPRWFRNLQVILPDLLDRIIALYSRISAEHLPPLPMAEAIIRCSRTLTGLHLTDGCLEADTLGLLVLGRAPTKVLSSSPRLTVTPSRTLIVNMMFKAFPNSSTEMLSAVDRIAILSGIASVLGMLGYQRKKAMVIRELVSVLIGGLVEARTRGAAEVGIHPAAGLAALNGVSGHTTGAAALDLGEGDIEESIDVFLGLLLRTYGVVSFEMDTLVSPTKDMETAHTDDGAVVRIQKQAAARFFGIPALKLNILRACINFSEALPDFNGVLKYSSDLLRTAGSGLAPGPRREDAAPIISRDEQVRLITNILKTSSLSQRLGMGEMLADFWDEFFLRGVKLEPLPRTRATIEHKKSELAGASTARESQDVDPLIHNPFLKPPDKAAVESTLVAFEPATFKLTLQNPYEIEVEIESVRLDTEGVEFESSVDSALIGPYRTQILRLVGIPKAAGSLKITGAIIKVRGCRERRFPIFPSPWSPEDQPKVKAIGLAALEQHVLEPASQAPKTDHISLNVIDEQPVVVVKSTSLAQSSVMILEGESQVFSVTLQNLSKTTAADFLLFSFQDSTQEPLQAALSKRNATPQELYEYELILARKQALRLKPRADHKRYIGPGEEATFDFQILGKPGLTGGIIQVDYAHLGVPPEDVPAKFHTRQVALQLTITVNASVELTRVDVLPLHEGIPRPLLETAFRRGDGASSLKEIQEKVSSDDYCLLLLDLRNAWPSYMQVELSTEDGALIEETILPGYTSRVMVLLKRVYLEDPHAAVPTLNPARQRQFVVSTTISPETERANREAFWYREELLNRIKGSWRATSGTNRHGAIELRSIRLSPRMIDAVKIEDVDIDISVASQNPGDDESKNVLYVDEFSRLNVHIINRSAKPIYPTLRLMPALCHRPLNVALDYTRKFGWIGTLQKSLPLLEAHGETNVVMTVAALCRGQFEVTASVEETQLWRDEGATAKGSDEGGRPRSDTQTLMDAVLGARERRIWHTRKPFTVTALDRDG

SEQ ID NO: 25 - DNA, 3216 bp, Magnaporthe grisae
atggataacccatatcccgaagaagcgctgcttgacaaccaccagctcatacaccaagatgagcagcttggtcaaactgtttttacaagagaagactttgaatatgcgctgagagattttcaagagatgtctggaggagaggacgggggtgccgtctctgaggtatcagatgcagactcagtgtatctcggagtccaagagcagatcaaccgggcccaggcagacaggactgcgtttcttgacgccttccaaaatccccaagaagacgacgacgaagacatttatgatggccttccaacaaaacctcccccgcgtaaaaaggtcaagaggggacccgtggtgaggaaaggaccaccaatcaagaaagcgcctcgcaaggccaaagaattgcccaccgagatcaaggtgcttgtcgatgccgcgaccaatgccttcatagccaatcgatacgatgaggctctacaggccgcaagggaaactatccgcctcaatgcggaagtggctccagcctggggcatcctggctgccgtgtatgaggagagagaagactggcggcacgcgctcgaggcaaaacgtatccaggcctcactcaccaagggcgacacacagctttggcttggtactgcagacttggctttgcacatggtagatggcgcctatcaggattcacccgaggaaatcgacaagactttgaaagtagctatggactgctacaggagcgtattacagatcgacaagacaaaccccgttgctcgcctgggcaaagccgacatcctcgcggacttgggacagtccagcaaggccgttgctgcttatctcgactacctcaaacagaaaccttataatcttcgtgtcgttcgcagcctggccgagcacgcgtacaatgcaagacgggcaaaggaggcaatcgaagctactgtactggcatacgaagcttgcattcagcatttcaaatcggggcagaccctggatgacgatcaagtcctcgactggatcgacgtccgcattttcatagagctccttgcttccctggagaagtacgatgaagccgcaaaatggctcaagactctggtgaggtggctggtaggccgcaacgacgaccttctctgggaccagtgccaggatgaccgtgagtgggacttggatgatactcgaaggttggaaatggaaggtttcaatcaaggcgagttcctgccccaaagctatggccatggcctgcccctcgagctcaggggcaagcttgccgtctatcggtttaggacagacatggaagacgaagcaatgagacatctcaggcaactcgacccggaagatgcagacataagggggaagctacaattcacccctgagattgccaaagaggttgcagatcagctgtgcgaaagcgggaagcccgagcgcgccattctatactatgacctatatcgggacctggtaggcgaggcattggatgccgaatattacgtcaagcgagccaagtgccacgtgcaactggcagatgggccagcggccgaggattgcttcatctacgcgcttgaagtagacgaagataacatcgaggcacgttacgagctggcaaagatgtacgaggaggcacaggaacgagacgaagccttcaggctggtgggcgaagccctgagcctggaagctgggcagagtgtctacgatggtctcacgcaccgctacgtcgtggacaggggtaagattgtatccaagcccaaaaagtacagaacaggcgccaccaagcgagccccaaccaccaaggccaaatacagaccgcgaagacttatcggcggtggcagtggcgagtcggcacgcaagaagtttgaggatgaggtcacggcacgccttcgggaaaggtacaccgagtgtcaacggctcaaggcgcagatggacgcgaatgtggctgcaagtggcgggcatgacacaaatgacccagtggttgccgaatggatgtcggctgccaaggagttggtggacgacttcaggtctttcagggagttctactcatgggagcgatacgtctcctctctcggctacgggaatttcttcaaggccgaggcatctgcagacggaaatactggcgatgagaggtctaggtctattgccaaaatggcgaaaagactacacaacaccctcgcccccgtcgagaccgaaggcgaagaagccgtaccgcaaaagatcgagcgccaagagcatcgcggcatcccattcaacgactggcttgacctcttcctcgaatacgccatctcgctggcccggcagcaacggatcggcgaggcgtacgccgtgtgccaatcagcgcgagattcgatcgtctacggtaaggccaaggacagcctgatgctgatacacctggcctgggcgtcgtgcgccgtccaggccggcgacgaggagacgtgcgtcgctatcgcgcgatactttatgatccacaaccccttcgtcaccgacggctacaagatgtttgccgccctcacccgcgtctgccagacctcgcccacctggtaccagtccggcccgtcgcaaaagttcatgctccgccagattcgccagatggacgagatcctggccgccaaggccaaggaggaagaggacgggttcggcgcggcaagcaaccaaggctcgcaaccacctggcccctcggcagaaacgcagatggtccctgccacagccgccgccgcgcaaccgggccccacaggcgtcgacgcggtcctgctcgtcctgtacgggtgcatcctgttcgcgtcgacgagctaccagtacgcgttggcctactttctgcgcgcgcggaccgtcgacccggacaacccggccatcaaccttgtcataggcctggcctacatccactgggcgctcaagcggcaatcgcacaaccgccagtacacgctaatgcagggcttctcatacatcttcaaatactacgaggacagaacgcgcggggccgccgcgccagaggagcgccaggaggcgcactacaacgttgcgcgcacctaccatctgctgggcatccacgacctcgccctcgagtactatcacaaggttctggtcgaagccagagccgccaggacggaggtgctgcgaggcaaggacgtttccgttaggcgtcgggaggatctcagtctagagtctgccatgaacattcggacgtactgtctgagcacaggggatttggaaggtgccagagctgttactgatgaatggttggttttggagtag

SEQ ID NO: 26 - protein, 1071 aa, Magnaporthe grisae
MDNPYPEEALLDNHQLIHQDEQLGQTVFTREDFEYALRDFQEMSGGEDGGAVSEVSDADSVYLGVQEQINRAQADRTAFLDAFQNPQEDDDEDIYDGLPTKPPPRKKVKRGPVVRKGPPIKKAPRKAKELPTEIKVLVDAATNAFIANRYDEALQAARETIRLNAEVAPAWGILAAVYEEREDWRHALEAKRIQASLTKGDTQLWLGTADLALHMVDGAYQDSPEEIDKTLKVAMDCYRSVLQIDKTNPVARLGKADILADLGQSSKAVAAYLDYLKQKPYNLRVVRSLAEHAYNARRAKEAIEATVLAYEACIQHFKSGQTLDDDQVLDWIDVRIFIELLASLEKYDEAAKWLKTLVRWLVGRNDDLLWDQCQDDREWDLDDTRRLEMEGFNQGEFLPQSYGHGLPLELRGKLAVYRFRTDMEDEAMRHLRQLDPEDADIRGKLQFTPEIAKEVADQLCESGKPERAILYYDLYRDLVGEALDAEYYVKRAKCHVQLADGPAAEDCFIYALEVDEDNIEARYELAKMYEEAQERDEAFRLVGEALSLEAGQSVYDGLTHRYVVDRGKIVSKPKKYRTGATKRAPTTKAKYRPRRLIGGGSGESARKKFEDEVTARLRERYTECQRLKAQMDANVAASGGHDTNDPVVAEWMSAAKELVDDFRSFREFYSWERYVSSLGYGNFFKAEASADGNTGDERSRSIAKMAKRLHNTLAPVETEGEEAVPQKIERQEHRGIPFNDWLDLFLEYAISLARQQRIGEAYAVCQSARDSIVYGKAKDSLMLIHLAWASCAVQAGDEETCVAIARYFMIHNPFVTDGYKMFAALTRVCQTSPTWYQSGPSQKFMLRQIRQMDEILAAKAKEEEDGFGAASNQGSQPPGPSAETQMVPATAAAAQPGPTGVDAVLLVLYGCILFASTSYQYALAYFLRARTVDPDNPAINLVIGLAYIHWALKRQSHNRQYTLMQGFSYIFKYYEDRTRGAAAPEERQEAHYNVARTYHLLGIHDLALEYYHKVLVEARAARTEVLRGKDVSVRRREDLSLESAMNIRTYCLSTGDLEGARAVTDEWLVLE

SEQ ID NO: 27 - DNA, 3374 bp, Magnaporthe grisae
atggagcaaccgttgttccgcaactcgtcctcggcgcggactgagttgtttgccaaggtcggtaggcccatcatcagcaagcttgtgatgcggccgtccgcggcaccatcgcaagccaaccagttgctgcagttgacggatcgactctactccatccttaatggacaggtcagctatgacgcctcggctgtggatgcaaagattgcagaatatgttttcttcccgctgtcgttcgtcttcaagaataaggaggatcactctgcccgagtgctagaaaacgccatcaagtgtctgcggattttgattcagtatggctggcgatctaccatctctacgagtctgactcaacagctactcatacttctcacattcatcatcgccggcgttcctggccagcagaggacttcgccgccgccggaagagacggtccttgaatgctacaggtctcttgctgtcttgatcagagaggcatgtctgtcaagctccgtatcagaatccctggttgactccagtggtctaccaagtctaggccacaccgtaactgtcattttggatggcagcacggatggaatgactgcagatatccagcttgcggcactcgatgccctgaggactctctttgtctcgatgaaagaccgtgctgcacttgcatccttcctcccaggcagtgtgtcgactctgtccaaacttctctcgccacctgcgtcactcaagcttcagaaacgtgtgctctgttacggagcaagagtctttggggacgttctgaccagggtgctaggcgacatacacaatagagatgcgctgaggcagctcacctcagacacgaccggggagggaaaagacggcgagctgtctgggacagagctatctgcgtcttggctcaaagctacatccgctcaagtcaggatggcgctcgccatggtgctcaagttacgatcccacgagtcggataatgttcggaatgccgttgagaggcttgctctatccctcttagacgaatgtcatgcgtctttggctgactgcacagtatttctcgtcgagacggccatttttacctggaagaagaagatgattcaactgatctatcggggggtccaaagcataccgcttcaagcattcgtgactctgctctgccagaaagcgtagcggttcaaactaccttgcaggacctggccatgatatacccggaacttcaagatgctatcaagaccgtggtacataatatgattaccagcatgcccagaatcatgcaaacttcagacgaaaaaattaagcagcagtgcatatttgcactctctcgagggcagcgaatagtgaaagtcctgaatattgactcgtccctgttgcatgaagcactgtcctcggctctgagagacagcattgtggctttgacctcaagcaaaaaacaactgaacgtcgtggccgacgctgaatttgaaggggagatgagtgtcaaccccacagacttggttacacggccgggtgaaacgcgaacattcaagcccatcatgctggcgcatgggagtcaagcaggtacacgtgatgccttcctcaggttggtttccggtattggctcgccatctcagcaggcagatctggctaccgacatgatcagtctggcaagggatttgtcaggaatagatcaggtcacagccttatggctagcgtttgagttgctgaaagtagcactagccaagaacgagcaggacgagcagttctttgacttttccggcaccatgtcaacaaatgagcctaccgaagtcttccaagagctctatcagctctctgtcttgatgctgacatcacatactgacagtctcgaagtcgactggagactggaggccatagctattgaggttacgacttttgccgcctctcaaatgggggtttcattcaggccagagctcattgatactctctaccctatagcaacctacctgggctcacaaaatacccagctaaggcttcacgcgatgacagcgcttggcttgattgcgtcagcgtgtggatatcaggatgtgtccgagttgattgttgacaatgccgattacatggtcaactcggtatctctgcgcctgacttcgatggatgttacaccggcgtcactccaagtactgaggatgatggtgaggctgacggggccgaagctgttgcctttcctagacgacacagtagccgccatttttgctgctcttgataattatcatgggtaccccgccttcgtcgagcgattgttttctgtactctcagaggtggtgcagcagggtgtcaagtctgacgtgctcttgcttgaatcgaaggaatccaaaagtcttgaccacaggaaaagatcaatggcagcagcaaccatcaatgatattgaatcagaagtgaaagagaggattgcaaagaaacagaagaggagaaaggagaaagaggatcttcttccaggcgttagagccaaacatcctcagaagccgtggacttctgaagcaaaacagcttctagacgaaagggagaggaagatgaaagccgatgatgaggagaaagcagaagacacagggtcaggcggtgaggtcgagaaaccaaagccggtccgtacgccaacatatgaactgctgtcacgagttacgaccttgacgcaatattatttaacatcaccaactccgactttgcgaaaatcgttactggatcttctctctacaattactccatctatggccctggatgaggatgcatttctacccatggtcaactctctttggccggtcgtcatctcgcgccttcgcgacggggagccatttgttgtggctgcagcttgcagagccattgcggcgcttgcacaagggtctggggacttcctggcctcgaggatcaagactgagtggtgggactcgatgtccaggtggtgccaaaaggcaaagcagaatgccaagactggtgcgacaggaaatggtgggagaagtggaaagagcaacaattctgttcccattcactccggtcgaaatataggcagactcaacatggccttggttggcaatgaagttgtgctgccacaccgtccacagggcagtagtagacctggcagcggcggtgttgatactgaaaagtattcagacggcggactgggaaggtttgcgcaggcatcacaagtatgggaggccaccgtcgacatgctcgttgcactggtctcctttgtcaggctggatgacgaggtttttgaccaaatactggaactgctcgccgacgagctcgagagcaattcagttgctcgcaaagcactcgaggtggtcaatgcggatgcggtttggctggctagatttgaacgtggctcgctgacacaagatctcagtgtaccagtcatggacggaatcaggtttgctgctttggcataa

SEQ ID NO: 28 - protein, 1124 aa, Magnaporthe grisae
MEQPLFRNSSSARTELFAKVGRPIISKLVMRPSAAPSQANQLLQLTDRLYSILNGQVSYDASAVDAKIAEYVFFPLSFVFKNKEDHSARVLENAIKCLRILIQYGWRSTISTSLTQQLLILLTFIIAGVPGQQRTSPPPEETVLECYRSLAVLIREACLSSSVSESLVDSSGLPSLGHTVTVILDGSTDGMTADIQLAALDALRTLFVSMKDRAALASFLPGSVSTLSKLLSPPASLKLQKRVLCYGARVFGDVLTRVLGDIHNRDALRQLTSDTTGEGKDGELSGTELSASWLKATSAQVRMALAMVLKLRSHESDNVRNAVERLALSLLDECHASLADCTVFLVETAIFTWKEEDDSTDLSGGPKHTASSIRDSALPESVAVQTTLQDLAMIYPELQDAIKTVVHNMITSMPRIMQTSDEKIKQQCIFALSRGQRIVKVLNIDSSLLHEALSSALRDSIVALTSSKKQLNVVADAEFEGEMSVNPTDLVTRPGETRTFKPIMLAHGSQAGTRDAFLRLVSGIGSPSQQADLATDMISLARDLSGIDQVTALWLAFELLKVALAKNEQDEQFFDFSGTMSTNEPTEVFQELYQLSVLMLTSHTDSLEVDWRLEAIAIEVTTFAASQMGVSFRPELIDTLYPIATYLGSQNTQLRLHAMTALGLIASACGYQDVSELIVDNADYMVNSVSLRLTSMDVTPASLQVLRMMVRLTGPKLLPFLDDTVAAIFAALDNYHGYPAFVERLFSVLSEVVQQGVKSDVLLLESKESKSLDHRKRSMAAATINDIESEVKERIAKKQKRRKEKEDLLPGVRAKHPQKPWTSEAKQLLDERERKMKADDEEKAEDTGSGGEVEKPKPVRTPTYELLSRVTTLTQYYLTSPTPTLRKSLLDLLSTITPSMALDEDAFLPMVNSLWPVVISRLRDGEPFVVAAACRAIAALAQGSGDFLASRIKTEWWDSMSRWCQKAKQNAKTGATGNGGRSGKSNNSVPIHSGRNIGRLNMALVGNEVVLPHRPQGSSRPGSGGVDTEKYSDGGLGRFAQASQVWEATVDMLVALVSFVRLDDEVFDQILELLADELESNSVARKALEVVNADAVWLARFERGSLTQDLSVPVMDGIRFAALA

SEQ ID NO: 29 - DNA, 2496 bp, Magnaporthe grisae
atggccaccgatgcccaagggcctggctccctcgggaacaaggcagccgcctcagatggcatgccaaatatggtgatgccatatgaacctcaggaccccgctgtcatcgcagagatggtccgcgtgctcgatgagcatacaaagggtggcgccaagggtcgtttccgtatcaagaagaccaagtttgccgttactggttctccttccaaggtcactgtagattcctggaagctacaggactgggactacaagaaacctgggctgcctacatatgcccgtggcctcttcaccacgcgcctcccaaataatgtaccagaaattgccgtcagaggttatgacaagttcttcaacgtcggcgaggtgccggaaacgaactgggaaaatatcatcaagaacagcaagggtccttacgagctcagtctgaaggaaaacggctgcatcattttcatctcaggccttcacgatgacaccctgttggtatgctcaaagcattccactggtgcacgcggtgatattgaaatcagccacgccaacgccggtgaaaaggctctcgacaagcagctggccaagattggcaagactagggcggaccttgcgcgggagctgagggagcgcaatgccaccgctatcgccgaactttgcgacgacagctttgaggagcacatcttggcttatggccccgataaagccggcttgtatcttcacggcatcaacgtgaaccagccctacttcatgacatatccaggccccgcagtcaactcgtttgccgacgactggggcttcaaacagaccgggttgctcataatggacaacattaaagaggtcaaaacgttcttagaagacgtagcagaaactggagcctacggcggccgagacgtcgagggctttgttatccgctgcaagctgaaggaccggcctaataccgaccctggaacatactcggattggttcttcaagtacaagtttgaagagccttatcttatgtacaggcagtggcgagagtgtaccaaggctctcattgccggccacgcccccaagatcaggaaacacaagaaaatcacagaggagtacctgtactacgcaaagacacgcctggcagaggactccagcctcgcaaaggcctataaccaaaaccacggcatcattgcccttcgtgacgattttctgaaatacaagaacatgaagggttccgatgctgccaatctcgatcgggatgtcgccactaacgagccggagccagacaactcggtcgttggcaacgtgatcctcgttccgattgccaccattggatgtggaaagacaacaattgccgtcgccttgaggaccctcttccctgaagcgttcggccatttccaaaacgacagcataacacagaaaaagggaaggccggctatatttaccaggaatgtgctggaacaactaaagacaaagagggttgtcatcgcggaccgcaacaacgcatggcgtcgtgagaggacacaaatcctgggcgacgtcaagaatatgctgcccgcagcgaagctggtggcgcttcatttcgaccacgacaacagcatggaagtccgcaagctgacatacgagcgcgttttccagcgtggcgacaaccaccagaacatcaaggtgcaggagctcggcaaagcaaaggtcatggacatcatgaacggcttcctggatggattggagccatacagcgccttcagcaaacccgatgcagacttttctgctgccatcggtctaaaccctctcgccggcagtcggacgaatctggaggtagtgatttccaaattacaccagttttacccaaaccttctccctcgcgtccccacgggagaggagatggacaaagcgatcgatactgcactcgcatatgatcccaagttagagcagctggcagttctgcccgcagctgctaacaacaacaagggtggtattgagtacatgtcaattgatatcccgtcgcaggccgtcctggccgccctcgaggatgccttcaaggatgcctcccccgaggtaggccgcatgtatggatacctgaagcagcagcgccggatccagccggctttccatgtaacgctgatgcataaatccggagcaaagaccagcccagagaaccaagagctttggacaaggtatactcagaccttgaaggtggctcacgatgatgccaagtcaaagggcatcgtattcagggctgcggaaacccccagcctgggtgaatgcgacgtccaacttgagcgcgtggtctttgacgacaggctcatggcgattgtggtgcgcataatcgacaaagacgacaagtggaagtgtataaacagggttccgcacatcacgatcggtactctggacaacacggtgcctcccaaggagagcaacgatatgctggctctttggatcgacggacagcaggaggctcgccgcggtacaatccgcgagactggcattgagggccgtccaatcgtcaagggcatagtcaaggcggtcctgtcaaaattctga

SEQ ID NO: 30 - protein, 831 aa, Magnaporthe grisae
MATDAQGPGSLGNKAAASDGMPNMVMPYEPQDPAVIAEMVRVLDEHTKGGAKGRFRIKKTKFAVTGSPSKVTVDSWKLQDWDYKKPGLPTYARGLFTTRLPNNVPEIAVRGYDKFFNVGEVPETNWENIIKNSKGPYELSLKENGCIIFISGLHDDTLLVCSKHSTGARGDIEISHANAGEKALDKQLAKIGKTRADLARELRERNATAIAELCDDSFEEHILAYGPDKAGLYLHGINVNQPYFMTYPGPAVNSFADDWGFKQTGLLIMDNIKEVKTFLEDVAETGAYGGRDVEGFVIRCKLKDRPNTDPGTYSDWFFKYKFEEPYLMYRQWRECTKALIAGHAPKIRKHKKITEEYLYYAKTRLAEDSSLAKAYNQNHGIIALRDDFLKYKNMKGSDAANLDRDVATNEPEPDNSVVGNVILVPIATIGCGKTTIAVALRTLFPEAFGHFQNDSITQKKGRPAIFTRNVLEQLKTKRVVIADRNNAWRRERTQILGDVKNMLPAAKLVALHFDHDNSMEVRKLTYERVFQRGDNHQNIKVQELGKAKVMDIMNGFLDGLEPYSAFSKPDADFSAAIGLNPLAGSRTNLEVVISKLHQFYPNLLPRVPTGEEMDKAIDTALAYDPKLEQLAVLPAAANNNKGGIEYMSIDIPSQAVLAALEDAFKDASPEVGRMYGYLKQQRRIQPAFHVTLMHKSGAKTSPENQELWTRYTQTLKVAHDDAKSKGIVFRAAETPSLGECDVQLERVVFDDRLMAIVVRIIDKDDKWKCINRVPHITIGTLDNTVPPKESNDMLALWIDGQQEARRGTIRETGIEGRPIVKGIVKAVLSKF

SEQ ID NO: 31 - DNA, 2691 bp, Magnaporthe grisae
atgggtgaagcacagagtcctccccggctcagcccaagaaagaagcgggcgcagaagcccctcggcaatggcttcttcggcggtatcaaagaaacaccaggcagggcagcaccccccctctctagtgcagcaccatcctcgtcgccggcctttgcgacgcccgctcacacactgcggcccttcaacccgcaaaagcccgccggagcagccatcctcccgatcctcttaccgccagcaacactccgcccattggccttccggacctttaccaaaaaacacagcctgaccctcacatcgtctgctctacaagagctggcgtcctttgtcggccgacactgcggctcaggatggcgtgaggaagggctcgccgagcgtgtgctagaggaggtggcaaaatcgtggaaggctggcaatggcggggtgatagtcgatggggccagccccatcctgaaggacatcctcaagacgctggaaggcaacatggttgggggcaagattgttactggtgcaggaaagggcttggttcggcagaatagtcttctgttggatccctcgagggaaccggactattcttctaccacccgcctgggcctgagaccatctattgcacttcaacgtgatgacagccagtctagtatgggcatgtctgggctcaacttcgaggaagagcccgaagaagacacgctcagtgatccaagaaagtggttgaaagtagttggggcatatgaacagccacggatggtttataacgtggccaaaaagcacttcgagagagatgcttctaaaccttcgatattaccaacagcttctcataagacccttttgtttcgcaatcgattcaacgtcatccaccagcgtctccttcgtaatgaagcctttcagacatccgccgtcgccgacaccaaacgcggctcacttgcccgttcaacgtcatccctctcatcacaacagtcatataaaatcacacccattgccaacttacttggacgccacggcagccaccacatgcttttaggaatgctggtaataatgccggcaggtaaccttgctgtcagtgaccttaccggaactattgcgctagacgtcacccaagcagccaccattcccgacgattcttcatggtttaccccggggatggttgtgctcatcgatggtgtttatgaggaggaggatgaccacaccgccaagggcctcagtggcagcagcggaattggtggcaccattggcggtcgatttcagggcttcttcatcggccagccgccatgtgagaagaggcgagcgacactgggtgtcagcggaccagaaggcgatggtttggagcacaccatagggggtggctttggatggattgactttctaggagttgggagcgagcgcgcgatgggcccgaggatgcgaaagctggaaagacgtttactgcgccaaccacagctttctcgacaagacatggccgcgtcggtactggagtccactctttcatcaacgctccccagacgtggccgaattatcatcttgggcgagctgaatctggaccagcctcgtgctctgcaggcattgcgcaagattctggccacatatgccaacgaaacagacaatgatggcagcgaaaacgacgccgctgacgagactgttgcaagcacgaaacccaacaagaccacgacacctttggcctttgttcttgcgggaagcttttcatcacaggccgtaatggctcggaacggagctggtggaggtggaggaggcggatccgctggattaaccggtagcggcggagggggcagcatcgagtacaaagaatactttgattcactcgcggggactctagccgaattcccatcgctcctacgagaatctactttcgtctttgttccgggcgataacgatggctgggcttcgtcatttggcgcaggtgccgcggtgcctctaccgcgcaaggccgttccagaccttttcacgtcgcgcgtccgtcgcgccttcgccaccgctaacgccgaagggacctcgccacgagcgaacgcgcctgggggcgaggccgtcttcaccaccaacccgagtcgcatgacgctttttggtccaaatcacgagatagtcctgttccgcgatgatatatcagcgcgcctaaggcgggctgctgtgcggctcaaaggctcgtcctctacctccaccggcccagagcacgacaacaacgaagtgcgcatgtcggacgacgccccgacagcaggggacatggaaattgacgaactgcctgatccggctgtagagagcgcagcttcaaaagagccaagaccagacatggtgccgcatgatgtgcgcgcagctcaaaagctcgtcaagacgatccttgaccaaggatatctggctccatttcgcacagctgtccgccctgtacactgggatcacgcctcggcgctacacctatatcccctaccaactgcactagtgctggccgacgctacggcgccgcccttttgtgtgacgtacgaggggtgccatgtcatgaatcctgggccgctactcgtaccagggaggaggggagttgcaagatgggttgagtataacgttgggcatagaggaagcgtgaaagagtatggcgaagctgccatgaaaaaggggcaggatccgttgactaatgacacgaacattattgaggcgcctgtcatctgtcaaattagccacctcggtccagagtag

SEQ ID NO: 32 - protein, 896 aa, Magnaporthe grisae
MGEAQSPPRLSPRKKRAQKPLGNGFFGGIKETPGRAAPPLSSAAPSSSPAFATPAHTLRPFNPQKPAGAAILPILLPPATLRPLAFRTFTKKHSLTLTSSALQELASFVGRHCGSGWREEGLAERVLEEVAKSWKAGNGGVIVDGASPILKDILKTLEGNMVGGKIVTGAGKGLVRQNSLLLDPSREPDYSSTTRLGLRPSIALQRDDSQSSMGMSGLNFEEEPEEDTLSDPRKWLKVVGAYEQPRMVYNVAKKHFERDASKPSILPTASHKTLLFRNRFNVIHQRLLRNEAFQTSAVADTKRGSLARSTSSLSSQQSYKITPIANLLGRHGSHHMLLGMLVIMPAGNLAVSDLTGTIALDVTQAATIPDDSSWFTPGMVVLIDGVYEEEDDHTAKGLSGSSGIGGTIGGRFQGFFIGQPPCEKRRATLGVSGPEGDGLEHTIGGGFGWIDFLGVGSERAMGPRMRKLERRLLRQPQLSRQDMAASVLESTLSSTLPRRGRIIILGELNLDQPRALQALRKILATYANETDNDGSENDAADETVASTKPNKTTTPLAFVLAGSFSSQAVMARNGAGGGGGGGSAGLTGSGGGGSIEYKEYFDSLAGTLAEFPSLLRESTFVFVPGDNDGWASSFGAGAAVPLPRKAVPDLFTSRVRRAFATANAEGTSPRANAPGGEAVFTTNPSRMTLFGPNHEIVLFRDDISARLRRAAVRLKGSSSTSTGPEHDNNEVRMSDDAPTAGDMEIDELPDPAVESAASKEPRPDMVPHDVRAAQKLVKTILDQGYLAPFRTAVRPVHWDHASALHLYPLPTALVLADATAPPFCVTYEGCHVMNPGPLLVPGRRGVARWVEYNVGHRGSVKEYGEAAMKKGQDPLTNDTNIIEAPVICQISHLGPE

SEQ ID NO: 33 - DNA, 2358 bp, Magnaporthe grisae
atgggtaaacgaaagagcgaacagcaccgaggccaccatgggcgcaagaggaggagattggcggccgaacgcgagaatgaggcggccgaggaagccaagcacaacatcgaggagcaacccgccgaattgaacataatccatgacgacttcatacctctcgatgaagacaccggtgcagcaggccctccagagacgcgcgagtattttggaatgctcaccgaagacgagcaggaggagttcaagcgactagacaatgccctcgaggacgacgacccgaacgtggaccgtgaggagctcctcgccacgatatttgaagtggccaagggcaaggaactcaagctcgcctgtagtcagtcgtgctcgaggttgatggagcggttgattctgctgtcaaacacaaggcagaagaagggccttttcgatgcctttgcgaaccatttcccgacgctcgtcactcacagattcggcagtcattgctgtgagcagctgttcttgcagtctgctccggtaatcacccgagagctgactggagaggttgagggcaacgataaggatgcacaggaggagggcgccggggacggtgcagagaagcagcccttgttgaccatggaggagctgttcttgttagtcttggatgagcttgaggagcatttgaccgtcctgatgaccgacaccttcggctcccacacactccgagtgctactcaccgtcctttccggtaggccgctgagtcaagtggcgaccaaaagcctacttcagagcaagagaaaggagcagatcgctttaccagacgggtggacagcaacggaggaaactggcgaccaaccgagagctgttccggcatgcttcgatatggcagttcgcaagattatatccgatgttttagttgcactagacccgaccatgctcgccgtcatggtcaagcaccctactggcaatccaatcctgcaactgctgctcgagcttgacattgcgctcaatacaaaagccaacagcaaacgcaagtcaaaagctcaggaagcggaggaggcaaagttggaggcagctgaagaaaagcccaaggaggaagcgggtgcgccacaaaccttgcttgagcgcctacttcccggtgcaccgtccaccttgagcgaagagacctcggaagcggcaaggtttgtcagtggcacgatctacgactcgataggatcacgcctgctcgaaacactcgtaagccattgcccaggcaagatattcaaaggcctgtggagtcacatcattgggcctcggtttgagacactcctccgtaacgagacggcaacatatgtagcaatgaaggcattggtcaggctgagtcgagaggacttggcggacgccgtgcttaagacgataccgaaagtggaaatgctagtgtcgaaaggccgcttcaatatcttgacgctgctgtttgagcgctgtcatgcccgtgaagcctctgtatcagcagatgctctgctaaaggctgtaacagaggcgtgcagcgcattgggtggatcacttgtccgcacgctgtgttatcttgacgacgaggacaccaacaaggaagaaaagaaagacaaggtcaaaaaagctgaaaaggaccaaggcgacaagaaagacaagaaggataagaaggacaagaaggataaaaaggagaagaaggacagaaaagacaaaccggccgtttctcaagagaaggaacctcttgcagatccaccaaagaagaaggatgatctcatccgcaatggcaccaagttggcaacaaccatgatacaaattggtgggaaaccggcacaggccgtacagggctctctcctcttccttgaccaagaaaagctgctgcacctagcgacatcgtcaaccgcgacagccaaattcttgacagcagccttgtccgctccgtcttcgaaccccatctaccacaagatgctggtaacggcactcaagccgcacgccatggagctcgcgcattcgttcaccggatcattcgtgatcaacgccgtcgcgctgattccctccaaggcagagggattcgcgcttcccttctttatcaagcaaagcatcgtcgagttgctgaccgctgacgatgcgagcctacgcagcactccccagggcaggaaggtctgggctgcgtggaagggcgagctgtgggttcgcaagcgggcagagtggatacggtgggcgarggaggtcgagcccgaggaggcccggtgggcaaagacgccacagccgagagtcaaggaagagcgtccgggtcagaaaggggataagaaggatgggagaggcccgaatggccgtcagtttacagacaaagatggcaaggacaaggacaagaagagaaaaaagcaggaggcagatgagtga

SEQ ID NO: 34 - protein, 785 aa, Magnaporthe grisae
MGKRKSEQHRGHHGRKRRRLAAERENEAAEEAKHNIEEQPAELNIIHDDFIPLDEDTGAAGPPETREYFGMLTEDEQEEFKRLDNALEDDDPNVDREELLATIFEVAKGKELKLACSQSCSRLMERLILLSNTRQKKGLFDAFANHFPTLVTHRFGSHCCEQLFLQSAPVITRELTGEVEGNDKDAQEEGAGDGAEKQPLLTMEELFLLVLDELEEHLTVLMTDTFGSHTLRVLLTVLSGRPLSQVATKSLLQSKRKEQIALPDGWTATEETGDQPRAVPACFDMAVRKIISDVLVALDPTMLAVMVKHPTGNPILQLLLELDIALNTKANSKRKSKAQEAEEAKLEAAEEKPKEEAGAPQTLLERLLPGAPSTLSEETSEAARFVSGTIYDSIGSRLLETLVSHCPGKIFKGLWSHIIGPRFETLLRNETATYVAMKALVRLSREDLADAVLKTIPKVEMLVSKGRFNILTLLFERCHAREASVSADALLKAVTEACSALGGSLVRTLCYLDDEDTNKEEKKDKVKKAEKDQGDKKDKKDKKDKKDKKEKKDRKDKPAVSQEKEPLADPPKKKDDLIRNGTKLATTMIQIGGKPAQAVQGSLLFLDQEKLLHLATSSTATAKFLTAALSAPSSNPIYHKMLVTALKPHAMELAHSFTGSFVINAVALIPSKAEGFALPFFIKQSIVELLTADDASLRSTPQGRKVWAAWKGELWVRKRAEWIRWAKEVEPEEARWAKTPQPRVKEERPGQKGDKKDGRGPNGRQFTDKDGKDKDKKRKKQEADE

SEQ ID NO: 35 - DNA, 3048 bp, Magnaporthe grisae
atggccgaaaaacttgatgaggaccaggtttccggtctcatcgccatactccgcaaggacgtctcggtcgacgccaaagttcagcaagtaaatgcggtcaagtccagcatcaagcagcacaatgtgcctgataactgcgtcgtaccggtattcgaggccttgcgcatcgcatctaccgcccagcatgccgtcctggtcaacgccggcttcactggcctcaaccaccttataacacgaatgtcgcgacaagatccgaagtaccttagcaaagaggctgtccgtctactgccgctgctcacagagaagcttggagaccagaaggaaaagttcaggacagttgctacgcagtcactcatcaccatgtacaaagccacacccgcagaagtcgagcgagtgatccgcaacgtagccatggtgggtaagaaccccagagctaaggaagcaagtctacactggcttcttcagatgcaccaagaacatgggctccagtttcgcgcctatgtgcctacccttatggatttacttgaagacgccgacgctgctgttcgagacgcagcaaaaaccaccgttatagagctgtttcgaaatgcgccaaacgccgccaaatcagatttgaaaaagcagcttaagaatttcaaggtgcgccctgcgatcgagcaggccatcgtcaaagaactcgttcccgcatcgctctcggcggcaccctcggattccgacgctcgaccagcttcccgagccgaatccacgcgatcaacacgcgcaaatctttcggcaagcacgacatcggctggcatcgaacgtccggttacccctggtcttctcgacagcaaaccggaaaccgtcgatcccacctatgtcaatacccaaagagaactagatgatatcgtcaaggagatgcacctctatttcgagggcaaggagacggagcagaattggctgcagcgtgaagaaagcattaagaagctcaggcgactgttggcgggtaacgccgtctcagacttccatgacgcgttcctcggcggtgtgcgcggacttttggacggcataatcaaagccgtcacttcactgagaactagtctttctaaggagggctgcagtcttgtccaagagctggctcttgcgtacggtccgggcatagaccctatggtggagattcttatgcagactttcatcaagctttgcgctgcgaccaaaaagatcagctctcagttggccaatgtcaccgtggacaccatcatcgcaaaggtcacttacaaccaccggattatgcaacacgtgtggtttgcttgccaggataagaacgtgcaaccacgaacttatgccaccggatggttgaaaacactgctcaacaaagaggctcagcagaagtcacacatcgaacaccacggagggctagatttagttgaaaaatgcatcaagaaggggctcgccgactccaatccattggtgagggagaaaatgagggtcacttactggactttcaacgaaatatggcccgcaagagcggaagcgattatggaagatctggatgccacggctaagaagctcctgcaaaagagctccggaaacacgagctcgcccaagccggccgctggtggtgcccggcctggcatgggtctttctaggagtaccatgaccgcttccaaaccttctttaagagacgccatgttggcacaaaaacgggctttagcttcaaagaatctcccagcaaggcctggatccgccatggcacatttttcacctgtggggactgcatcttcagcctcatctgcagcggttacttccactactaccgccaaaccccctgtccgccaaaagcagctgcaggaggcccccacttccactggatcaaatagcctttcggtcgctccaatgcgacccggtagaaagagactcgagctggcagcaagacctgctacagctggcccctactctgtgaggacacatgatacagtatcattggagcagaacagcccaccagagaaaacaaggccaaagtctgctgccagtaaggcggctgctccttcgcctcgcgcgagtccggcaaaaccaaagcctactgcaatcgctcgcactcttcgtgagagcagcccgtccaagccagttgatgcgcccagtccggctagaaccatggcctcaccgatgcctgggtctcccgtgtccgcgcctcctccagttctgaccgaacctacccaggagccagaaacggaacagcaagagactaggccagaatcaaggacgagcacgtctcctcatacaccgccacggccggtcaaggtttatgaagatccattcacggcggacgaaccttcgactaagccgaatttaacaagacctgttctcgaggatatcccgattaatgaggacgccgcaaaccttgttcgacctgtcgaaaccgaccctgttgtcgccagcaccgacggtggcccgccagacaaagccaaacacgatatccccatcgagaaggtaccggatgttaaggcacagattcttgctactatcaagctccttctcaagagggcccgcgacaactttcaaccacacgtatctcacgccctcgaatcgctcctcgaggcaagaggggtatacgaagctcgtacacatatagtctcaggcatggagctactggcagacgaactggtgactataggtgacccttcggaaatggtcgtagttctgacacaggccctgcagggtgtcgagatggacgcaaggggttgtcggtcgctcaacatgggcttgcacgttctgagggaagttgtcgatgcgcgtccggattttcatccgaccgaatctgaacttgccgccctgagcgggttggccgcgcgctgccttgaaagccatgagtctggcgtgcggatggatgcagtccaattgtgtgttgccctgcatgcccgtgtgggcgatacacgcttctgggacaacatcaagggtgtcaaggaggaccctaagagcctcattacctactacatcgtgaaaaggcagcgcgaacatgatgccgcagccagtaatggattgtcagcagctgccactgcgactgtcatttga

SEQ ID NO: 36 - protein, 1015 aa, Magnaporthe grisae
MAEKLDEDQVSGLIAILRKDVSVDAKVQQVNAVKSSIKQHNVPDNCVVPVFEALRIASTAQHAVLVNAGFTGLNHLITRMSRQDPKYLSKEAVRLLPLLTEKLGDQKEKFRTVATQSLITMYKATPAEVERVIRNVAMVGKNPRAKEASLHWLLQMHQEHGLQFRAYVPTLMDLLEDADAAVRDAAKTTVIELFRNAPNAAKSDLKKQLKNFKVRPAIEQAIVKELVPASLSAAPSDSDARPASRAESTRSTRANLSASTTSAGIERPVTPGLLDSKPETVDPTYVNTQRELDDIVKEMHLYFEGKETEQNWLQREESIKKLRRLLAGNAVSDFHDAFLGGVRGLLDGIIKAVTSLRTSLSKEGCSLVQELALAYGPGIDPMVEILMQTFIKLCAATKKISSQLANVTVDTIIAKVTYNHRIMQHVWFACQDKNVQPRTYATGWLKTLLNKEAQQKSHIEHHGGLDLVEKCIKKGLADSNPLVREKMRVTYWTFNEIWPARAEAIMEDLDATAKKLLQKSSGNTSSPKPAAGGARPGMGLSRSTMTASKPSLRDAMLAQKRALASKNLPARPGSAMAHFSPVGTASSASSAAVTSTTTAKPPVRQKQLQEAPTSTGSNSLSVAPMRPGRKRLELAARPATAGPYSVRTHDTVSLEQNSPPEKTRPKSAASKAAAPSPRASPAKPKPTAIARTLRESSPSKPVDAPSPARTMASPMPGSPVSAPPPVLTEPTQEPETEQQETRPESRTSTSPHTPPRPVKVYEDPFTADEPSTKPNLTRPVLEDIPINEDAANLVRPVETDPVVASTDGGPPDKAKHDIPIEKVPDVKAQILATIKLLLKRARDNFQPHVSHALESLLEARGVYEARTHIVSGMELLADELVTIGDPSEMVVVLTQALQGVEMDARGCRSLNMGLHVLREVVDARPDFHPTESELAALSGLAARCLESHESGVRMDAVQLCVALHARVGDTRFWDNIKGVKEDPKSLITYYIVKRQREHDAAASNGLSAAATATVI

SEQ ID NO: 37 - DNA, 1893 bp, Magnaporthe grisae
atggctgtaggcttggctaatggacgacatgccgccgaggaggaggcgcgcgccgaagtggatgtcctcaattcccgcctggaaaagacaacccagctcaccaagaagatcgaagcatgcctcgtgaggcttgaatcgaccggcaagagtgtccgtgaggtggctggacctctcaatggggagaccaaaaagttgcaggttcttgacattgataacgttctttccgcaatcgagagattacgagcgccagccgacagcaaaaacgacgaagagcaaattattcggatgggccccgagaaggcggacctgcccaactacctaaactctttgaaacgcttgaacaaagccctggtcgatatgaaggcatcaaaccttcgatcgaatcaacagacaatgaatgatctgcaacgcctcgtcactctgggaactactcaattggcaacccttttcgacaaactgttgcgcagcgaaacaccacgctcgctcgagcctctgcattacataacaaaggacaagccatttccactcctatcgcgagacaatgtcaaccgtttagggcccatatactcctttgtagcaggatcaaataggcaagggaaaggcgttgggtccgaatccacgattgccgaggtgtactcggaggttcgtggcccatatttggccgagactctggccaacttggctgccgcaagtgtcaacacggccaagaagaagaatcccgatgcagtttaccgtgccggaaccaatggcattggtacctacgcccaggccatggagcgtctgttccaggctgaatatgagaatatcacgaggatattctcccgggaagattgggcccctcttttccaagccacttgccagaacgcgattgtggagctttctcgcacccttcgtgagatcaacgctcacatcaaagttcatctgaatacggattgcttccttgcttacgaaattgttgaaatcatctctggcatgtcaagccgccttgaggatttgcgcgcagccttcgccgcctgtctcaagccagtcagggaaacggcgaaaacatcacttggcgagctcatagaggacaccaagagaaaggttgccaacatgcagtccattccagccgatggtgcaccctctcctgttattgcagagactatgcagcgactgcaaaccatggtagaatttttgaggcccgtctccagcataatgatatcaattggcaacggtgggtggaagtcgttggcctcatcacgtggcggtggcgatgccttaccaagcctggcctcctttgacgttggagcgaatggccaggagatctttgcggattactgcagtgatactatcgacattcttttgctctcgctggatggcaaagcacggatgatgaatggaaagaagccggttgtcggtgtcttcatagcaaacagtattgccatcaccgagcggtcgattcgcgagtctgatctggcgcctttgatggagacacgcctgggaatattggaaacataccgaaagaaggcgaagctttattacacagagccttgcaaggatgtgtctatgcatcttttcgatgtcatccatacaagcaagtcagctcgcccatcgtcaggccaggcttctgcagactcagcaaccatcctgaagcagcttagttccaaggacaaggaaagtatcaagaacaagttcacgtctttcaacgccgcctttgacgacatggtagcacgccacaaatctttcagcatggagcgtgaggtgcgtcaaatgtttgcccgcgacatgcagcaaatgctagagccgctttacgtccgcttctgggaccgatatcacgaagtcgacaagggcaagggcaagtatgtcaaatatgacaaggctgccattgctgccgttttcgccagcctttactga

SEQ ID NO: 38 - protein, 630 aa, Magnaporthe grisae
MAVGLANGRHAAEEEARAEVDVLNSRLEKTTQLTKKIEACLVRLESTGKSVREVAGPLNGETKKLQVLDIDNVLSAIERLRAPADSKNDEEQIIRMGPEKADLPNYLNSLKRLNKALVDMKASNLRSNQQTMNDLQRLVTLGTTQLATLFDKLLRSETPRSLEPLHYITKDKPFPLLSRDNVNRLGPIYSFVAGSNRQGKGVGSESTIAEVYSEVRGPYLAETLANLAAASVNTAKKKNPDAVYRAGTNGIGTYAQAMERLFQAEYENITRIFSREDWAPLFQATCQNAIVELSRTLREINAHIKVHLNTDCFLAYEIVEIISGMSSRLEDLRAAFAACLKPVRETAKTSLGELIEDTKRKVANMQSIPADGAPSPVIAETMQRLQTMVEFLRPVSSIMISIGNGGWKSLASSRGGGDALPSLASFDVGANGQEIFADYCSDTIDILLLSLDGKARMMNGKKPVVGVFIANSIAITERSIRESDLAPLMETRLGILETYRKKAKLYYTEPCKDVSMHLFDVIHTSKSARPSSGQASADSATILKQLSSKDKESIKNKFTSFNAAFDDMVARHKSFSMEREVRQMFARDMQQMLEPLYVRFWDRYHEVDKGKGKYVKYDKAAIAAVFASLY

SEQ ID NO: 39 - DNA, 1344 bp, Magnaporthe grisae
atgcgtgaaattgttcaccttcagaccggccaatgcggcaaccaaattggtgctgctttctggcaaactatctctagcgagcacgggctcgacagcaatggagtttacaacggcacctccgagctccagctggagcgtatgagcgtctacttcaacgaggcctccggcaacaagcatgttccccgtgctgtcctcgtcgatctcgagcccggcaccatggacgccgtccgtgccggtccttttggccagctcttccgccccgacaacttcgtcttcggtcagtctggtgctggaaacaactgggccaagggtcactacactgagggtgccgagcttgtcgaccaggtccttgacgtcgtccgtcgtgaggctgagggctgtgactgcctccagggtttccagatcacccactccctgggtggtggtaccggtgccggtatgggtactctgctgatctccaagatccgcgaggagttccccgaccgtatgatggccaccttctcggtcgttccctcgcccaaggtttccgacaccgtcgttgagccctacaacgctaccctctcggtccaccagctggtcgagaactctgacgagaccttctgcattgacaacgaggctctgtacgacatctgcatgcgcaccctgaagctgtcgaacccctcatacggtgacctgaactacctggtttcggccgtcatgtctggcgtcaccacctgcttgcgtttccccggccagctcaactctgatctccgcaagcttgccgtcaacatggttcccttccctcgtctgcacttcttcatggttggcttcgctcctttgaccagccgtggtgcccactctttccgcgctgtcaccgttcccgagttgacccagcagatgttcgaccccaagaacatgatggctgcttctgacttcaggaatggtcgttacctgacctgctctgccatcttccgtggaaaggtttccatgaaggaggtcgaggaccagatgcgcaacgtccagaacaagaactcgtcgtacttcgtcgagtggatccccaacaacatccagaccgctctctgctctatcccgccccgcggcctcaagatgtcgtcgactttcatcggaaactcgaccgccatccaggagctgttcaagcgtgtcggtgagcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 40 - protein, 447 aa, Magnaporthe grisae
MREIVHLQTGQCGNQIGAAFWQTISSEHGLDSNGVYNGTSELQLERMSVYFNEASGNKHVPRAVLVDLEPGTMDAVRAGPFGQLFRPDNFVFGQSGAGNNWAKGHYTEGAELVDQVLDVVRREAEGCDCLQGFQITHSLGGGTGAGMGTLLISKIREEFPDRMMATFSVVPSPKVSDTVVEPYNATLSVHQLVENSDETFCIDNEALYDICMRTLKLSNPSYGDLNYLVSAVMSGVTTCLRFPGQLNSDLRKLAVNMVPFPRLHFFMVGFAPLTSRGAHSFRAVTVPELTQQMFDPKNMMAASDFRNGRYLTCSAIFRGKVSMKEVEDQMRNVQNKNSSYFVEWIPNNIQTALCSIPPRGLKMSSTFIGNSTAIQELFKRVGEQFTAMFRRKAFLHWYTGEGMDEMEFTEAESNMNDLVSEYQQYQDAGVDEEEEEYEEEAPLEGEE

SEQ ID NO: 41 - DNA, 1855 bp, Magnaporthe grisae
accgtacatgatgcaatcgatgcatctttgagctgcttgatttgatagggacggatttactccgaaccacagcagcgacaggaattagacgagtgtcgccaattgagttggtatgagctgcctccaataggagaaatcaaatgatagtgggtctgcccgtgggggacagacagagctactccggaccagcttgaatttcaggctctcaggcagcaacttggagctttcattcacaaggacgcgtgcatgggtctgcctgagccagagcttcggactgcctgcgtcaatcgaggtgtacgtcttatggaacccacctaacctcaccaccatcaacgtccccatcgatatcacaactgcgttcccctctatccacccgcatcgagaccataattcaacattggaagattctcacctcgggaagtcttccgctttcgaaagtgatacttaattctacatccatcacataaatattggcgccacgacgccggagactcgccgccatggacaccctggtagcccgctacagccgcccggcttaccagcagaacgagacattcacagaagatgatcagcaagacctttgcgattccgtcccaagtctttcactcaagtttgcggttccgccagtagcacatccctcatcttggctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatgggtaccatgtgcgccggcgtcaccaaggaggagggtcccgccctgtactacatcgacagcgacggcaccaggcttgccggcaatctgttctgtgtgggatccggtcagacctttgcctatggtgtgctggatgccgagtacaagtacgacctgtcggatgaggatgcgctcgagctcggccgcaggagcattctcgccgccacccacagggatgcctactccggtggttttatcaacttgtaccacgtcaaggaggacggttgggtcaagcacggattcaacgacacgaaccctatcttctggaagactaagctggagaagggcgagtttaccaacgttacgagtgcgctggactagatgtttaacgaattatggcagtatgattgccttatttcaagcgtcgactcgggtctaggcatggcattgggaacaggatgacggctgtgacgaatcacaaaaaagttactcaagctgggtgtgatggtgggcaacgggatactctgttgtctggtccccgtgcgtgcacaggaatccgtaccattttctcatctttccctttcccccttttttttccggaaggcgaatgtctcaacaacgtgtactcaaaagacaccaggatcgttttacaggaattggcgcttggtgacaggccggttttagacaacccatctagctgattatgcaagttggacgaatcattcctcagtaggtcacgatgatataattgccagagaaattctgtgaagagccgccaaggtttgtagttatacttgacttgatttccatactgcacattagggctgccagtacctactcgctgtcattgccgtcgtcgagagcttcatcttcctcttccg

SEQ ID NO: 42 - DNA, 2674 bp, Magnaporthe grisae
aggaaacggtttacaaatcgcaacctggaaagcgtttctttttgcccttttcgtttgactcgccaaaaagtgcactccggtctttaggccaccaacggaccttccgtaatcacgcacgcacagtcagtcagttaggcaagccagttgcaagttgcgcgcctcgcgagcttggacccgacctgatctgaacttgacccaaccccgaaccaagcaacgaaaacaactacataccatccatctacctacacaacgtaacacccatcaaactgcacccaacaatccacaaccgaacaccctcgatctgtcatcatcatcaactctcacttatcctcgtctccctctttttcccactcccgctgcatcccgctcgcttcgtcgcccacgctaccacaagccgaacaagttattaatcacagcccgcggataacgtcatgccagggaagactcccaacgggaaacagccggttgagaacggcattaggaaaacacaggacgtcgacatgaaggacgagacatcacgaaagaccaagggaaagaagctcaaggagggtgacgaagaaatgactgtcgttgtaccgccgtccaagtcgtccaagcagtcgccaccgacccgatcggacgaggacgtagacatggacgagtctggaaaggttgatgatgccgaagtcaaggttgacccagcagttcaggccgtcgcagatatcaagagcaatttcgccctgttggacaaagctgttgctttgttcgatgcaagattcacgctgcgtgctctgcggtccatttcatccatccgcaaacggttgaccgccgacatcctcgcccaggcgattgccgagacgtttcctccgaccgcagcgtcaggggacgcagtcaaacaactgctcgcgagcatcggcaagcaagacgtgcaactcggacgccagtcgggctctgagatggagatcgatggcgaggtcaagggccagtcaaagacgagcagctctaagaaggagagcaaagagatcatcccagagattgacatcttcatgggaatcctcacccaggttttcctctatgattctaagcagcttgagcgcggagccgaattctcccagcacctttgcgaacggatccactccctcaaccgtcgtacactagactcgctttcggccaaggtttacttttactactcgctcttcttcgagaagcttgcgcctctgccgccgtctccgcagtcgccatccgtgtctatccgcccaaccctcctcgccgccctccggactgccgtgttgagaaaggatattgatacacaggcctcggtcattgtgctgctgctgcgcaactacctcgccacgtcgcacatcaaccaggccgacctgctcgtctcacatacacagttccccgagaatgctgcaaacaaccaagttgcgcggtatctctactaccttggtcggattcgcgccatacagctgcgctacacggaggcacacgagcacctgacggctgcgacgcggaaggcaccgagctctaactgcgcggttggtttctcgcagacggccaccaagcttttgctggtggttgagcttcttatgggcgatattcctgatcgcgcgaccttccgccaaccgaccctcgaggaggcactgcacccttacttcctgctagtccaggctgttcgggtcggtaacctcgacaacttcgagacgaccattgcggaccacgccgatactttccgcaaggacggaacctacaccctcatcctccgacttcgccagaacgttatcaggacgggtattagaatgatgtcgctttcgtacagccgcatctcgcttcgtgacatttgcatccggcttcacctcggcagcgaagagtcagccgagtacattgttgccaaggccattagggacggtgtcattgaggccaccctggaccgcgagcacggctacatgaggagcaaggaggtcggtgatgtgtacgccacgcgggagccaggcgaggctttccacgatcgcatccgtgcctgcctcgcgctccacgatgagagcgtcaaggccatgcgcttccccatgaaccagcaccgtcttgagcttaagaacgctcaagaggcgcgtgagcgtgagcgggagatggccaaggagatacaggatggagatcttgacgaggacgaccttgggggagaattcgagggcatgtaatattctcgatcctctttttatttttaaatcccccaccttttgcttgccttagagaggttccaacctgtgtttttgtacccctcgcatttgtgtaaagctttcttcaacccaaacgtgtacttgttatcacactttaccaaagagcttattcaaactggaatcttttacctttcttgcgatttctgagtccagcatgtctctttgtatctgggcacaagaagttgtttccattctttggtgatgaggaaggggacaaatgggggtggggtttttggcgcggagtggctacggcaatggcgacgacttttcttttcttttctacacagtagggaatgctctgtttgcgccttataatcgggaacacatggtaatcaaatgaatgggtgggtagggtataacggtatgcggtatggggcggatttgggttccagggcttttgtgttcagtcactatttcgttcttttccttgcgttttttttttttttgccccatcgcttcca

SEQ ID NO: 43 - DNA, 1702 bp, Magnaporthe grisae
  misc_feature (873)..(873): This nucleotide may or may not be present
cggcagtctccccttcacgctctgaatcgtcgtccgagccggaaccagcctcaaagtcatctgcatcctggtcctggtcattgtcggagtcggagtcgctgcctgatatcgattcgtcacgttccaccctttttttggccggagctgcggagctagccttgtctcttgatttggacggctgagctttcgacggcctagaaccgctggttgcaagtctctttttgggattttcaggggctccggtacgttttcgcttttgagcgccggggacagtaaaaaaagaagacattgttctgttgagaagccttcaatgggtggaggttgtaatactacctcgtctgcatcttgggagacttttttttttttttttgctgcggtctcctcccaaaggcggtccagcgcatgtcgcccgagaaatttttggcggggagtacagtcaaaaaaaaagtcgctgaaatcattggtggggcagtgagttaatcctattggttgtcagttacatgggtagcctgatcggatcattttcctgggtcagccccaccaaagttgttccggcaggcggtagcggagcttcgcagaacacactcaatatggaggttcttttggggatcacgggcaaggacttcaccttgatcgcagcrtccaaggctgcgatgcggggagccaccgttcttaaggcatctgacgacaagacgaggccactcaacaagcacaccatgattgcattttcgggcgagcctggagacaccatccagtttgcggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctcagtactactgcctctccatcctcgacaaacatcaccatcccgatatcaccctgcaccagggtatcaagatcctgactatgtgcaccgacgagctgaagaggagattaccgattgacttcaaaggaatggtggtgaaggcggtgacaaaggatggaatccgagacatcgaatttgatgatgacaagattgtcaagagtgcttgaagctgtttgtcggagccaatccccggcaccttcttcacgtcattttcgcggactgcaggcgctttgtactattagaatcggcgtagactggactgggttttaacggcgacagaaaatcaatgacaatcatgatgaaatcagtacacctagttaggatgctaccgggtggtgggttgcccataggcggaagtgcaagtgagaagctaaatgtgacaacggtaatgttatagtatgatgttacaattaaaatagtgaagcatactggggtcagggcagggattgcgctgttaacatcacaatgtacggtccatgacctcgttcttaatcttcgtacgtgttacgtcgtaggttatctacctacctcgctagcatgcctgatgagaatggacggacagaggtcacgacaagagtcgcgtttaatcttgtagaatagtgtatatgatgatttcagataagtgaggtaggtaccaaggtatgcagaactataggtacctgattaa

SEQ ID NO: 44 - DNA, 1388 bp, Magnaporthe grisae
agcctttgctgtaatttattttgtatgagtttcatttgtggttgagctaataagagttagacattgtagaatgaagtttcgacttattggaagccttgctgtgcctaatctgacggaggcaattgggacctgaccaagagggacggttccaggatcaaaatgcatcttgactcgttagacccgcagcacgtgagcgccctgaattatctcttgttgcagcgcggccgtgttttacgcagtcaattagcgtaggattaatgccttacatgtcaggcgcaaagcgaaagacacacacgaaaaggagctgccctaattctgcccagccgaatttcaccgccccgccgctcgcgaattgccccacaagcgcaccaccacaacgaaatttccattggcatcgtgggccgtttgcaacttttttgttctccctctccaactaaccagcagcaaatcaaccgcccacccgtcctcgtagatcagcgacatcgcgagacgccgacaagatgggtatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgccaacaccctcctcctccgcggccccaagaacgcccgtgaggctgtcaagcacttcggcttcggtccccacaagcacaagaagccttacgtccagtccaagggccgcaagttcgagaaggcccgtggtcgcagacgatcgcgtggtttcaaggtctaaatggccttgtcatcctcttttggggtctctttttgtttttattcaatgggcttgttactgctggctgttctcgtgggttgacgcaagaaaacgatatccatgttgtctcttacggtcgtctttggggactctttagtcagtactctcaaacaacaggagtttgcatgggtttcggcgtggaaatgggcaacaaaagaatattcatgaactttcggaatgcaaatatgaaattgagatgccctgaggcccttgaatcttatactatttgcgtgtatggctgtgttgtatgtgctagtgcaagtgaacaatctgtagggagcaatgtgatgtgga

SEQ ID NO: 45 - DNA, 2611 bp, Magnaporthe grisae
gtaggagctcacatgaaaggcctcatgtctgatggctggcttctatggtagttcactatgtataccttagggctagagtacaagtgcagggtaggtagtaagacagtcactttgattgtggtgcagggtaggtacgcgtatgtggctgtcaagcacggacccatatacgtgcgacaacggaccactgtcaataatttttgctgttggaaacggacgcgactgatatccaccgcgacaagtaacgccgacccacccagccgacaacctaccgtcgcaacttcgatcaatacatcacgtttgacgcagcggaatccggcaagatacgaatccttcatcaggatatcgatccgcaacaccaatggacacatattgagcagcggactcaattcgtaaggactaccagatcgagccgagcgacatagagcagaggacaagaaaacctcgtcgtagtaggccaaggccaaccccgtctcccgaaaacaaacagtcgcgcttgcaacatggcgaccaacggcgatgctgctcccccggcgccggcggcagagacggcagctgcgactgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcggccgcgttggcggccgccaagctggcagagcagaacaaggagccccagggcccgcccaagccgccggattttgagttctcggcgcgcatgccgaggatgaaccagaaggatcttgagatattgagggtcacggcgctgttcgtggccaggaacggaaggcaatttcagacccagctaatgcaacgcgagactaagaatccgcagtttcagtttcttatcccgaatcacaccttccacaatttcttccagcatatggtagatcagtacgccatcatactcaaggagagtggcatgggaggggatggatctaaggcccaggagcagcgaattgagcagctgcggcgcaatgtcgaggatcggttccacattctggagagggcaaaacagcgggctgagtatgcagtatggcaggagcaggagaggcagaagcaggaggctgccgaggagaagaagaaggatgactttgcacgcatcgactggaatgactttgtcgtggttgagactattgatttcaccgaggcagatgccaatattaccctcccaccgccgacgactctcaacgacatacaatacgcatcattggaggagaagcaaaacttctcagtcaacgccaagcgtatcgaagaggcattcccctttgatgataccagctacaatgcctatccggtacagcaacagcaatcacaaccagcacaacaagactcaccggcaggggcaccggcacagccggcacacatgcagcaggaccccgaggagacgcggaggatacaagaaagggaacaagcccgggcgcgcatgcaccaagcccaggcagatgccagaggaggaacggctccaatgaagatcaaggaaaactacgtacccaaagcggctgcccggggtccgaggaccggaggccagacggctctgtgtccaagatgtaaccagcagatcctcttgtcggagtgggaggagcacatgaggatcgaactgctggatcccaggtggaaggagcaaaaggccaaggcagagtcgcgatacgcgacgaccaacatatcgacggcggatgtggccaacaacctgaagcgtctggcgagccaaaggacggacgtgttcgacagcgtcacgggccagccgctctcggaggaggagatggcccgtcgcaaaaaggcagccatcaacagctacgatggaaaccccgacggcaagagccaggcgcacattgcacacctgcagcacgtcaatgtcgaggagcagatcagggctatccagcaaaagtttggagacaaaaaggaataattctgcgtaacagcagggtaatgatggtgttgcacttttttatgtttgaaactgctatggtgttcgtcttatactgccaagcttgctaacaacttgacctatttatgtacaaaacaagatcacggttactgctgcccaagaaagggcttccaacaaagggcatgtctcattggtgcgtcaatctagaacgctagtataagttcgtcacgtacgtatttaggtatctgactgtccatcactggcgatctcgatgagtccaaaatttgccttgaagccaagattcgctaaggcacccttgattaccgaataccacctagaatccaatggggagtaccatgttctaccgccccgccgacgcctactatacaatacaaacgcggcgtgcggtgcattgcatacgaagcatatataagactcgggcaatgtaagagtttgcggcaggcacccgatcgcccccacatttagatgatttcaaatggtgcaatattccgttgacagtt

SEQ ID NO: 46 - DNA, 1539 bp, Magnaporthe grisae
gaagattccgcgaggcccacccagcccgccgccgcccgtcatgcactcgccgccgcggaagttgacggctcaggaccaggaggactggaggataccgccgccaatctcaaactggaagaaccccaagggtttcacggtaccgctggacaagcgtctggccgccgacgggaggggtctacaggacgtcacgatcaacgacaaattcgcacagctatcagagtctctgtacgtcgccgacagacatgcacgtgaggaagttaagcagagggcgctcatgcagcagcgcctggcagagaaggagaaggcccagaaggaggagaatctgaggcagctggcacaaaaggcgagggaagagcgtgccggtgccggaagcagacgacggtccaggtctggcagccgcagcagccgatcctattcgtctggctcagacagcgaggaatctgacatccgagagcgtgaggaggcaaggaaagagcgacgcaaggaggaggaacgcaaattacgacagtctaggatgggagcggagaggagagtacaagtcatggcacgggagcagaaccgagatatttctgagaagattgcgctgggactcgccaagcccacgcagtcgtcagaaggcatgtacgattctcgacttttcaaccaatcatctggtttcgagggcggcatcaacgaggacaacccttatgacaagccgctttttgctgttcaggacgccatcagtagtatctaccggccccgtgcgaacaacgatgatgaggacgaggcggctggcgatgcggagatggccaagatacaaaaggcgagcagatatggtgaggtgctaggccgaggtacattctccggtgccggggatgtggaagcccgagaaggtccagtgcagttcgaaaaggatgctgcaggcgcggaccctttcaatgtggacaagttcctgtccgaggtcgaacagaccgcgtcatcaaagaggggttatggtctgcaagactcgagcaacgatggcggcaggccgaagagggctagggtggaggacgacgattgaaacttgtttgaaaacactatagggctcttgcaaaggcattacttgtttaatgggaccagccatgaattgatactatttacagatcattatgggtagcaacgctcttgtctgatcttaccaatcccttttcctacgagggctaaacacagtgttctcatcgcagaaaagagccgttcgtggatgaagaaaacatgttatccgtatcagcattcttcgtcaagggcttacgggcattttaaactcgtactccttactctaacgtcatctcttgtcgtgccatatcgtatcgtgtcaagccacactatctcgaatctcaaaagatcgacaactgtgtaattgggcaaagctaaagtaacttgcactcttttttttcctgttgctctggcccaatccttttcattcaacgtttctttcgcggttggtcgtttgttttgaatcggaatgatcgagtcgtgcacgaccgtcatgcaccggcacgatgaatcaaaaagctccgagtg

SEQ ID NO: 47 - DNA, 3631 bp, Magnaporthe grisae
catacggagcaaaagttagctgtatccaaggggatatggaaaaggcatactcttttcttttcttttcttttttctttactgtacttgggccgtttggtccaatccactttattgaccttagcccaaacaatgcggtttcttttccccctcccacacacacacacacacacacgcacaccacggttctcaccgttccgtcatcccacctgcatccacacgtgcatggtacacaaccaagccagcccgcttctacgcaaaccattatttgcccctcacctttactccgacccgtgtctgcctagaggcggtatattcccttatccatcagcaaacgccgacaccaacagacacgctactcgtctagatcaaagctaccgccaacctaccacatttaacggccgacactgcaagtcaactcgcccgcaaactcggatatttggctgactctcgaaacaacaaacatcagatagcctctgttgggcaacagcagaaggctcaccatggcgacgtcagacatcacgacggtgctcacaaattcgctgtctgccgatgcgaacctgcgacatgccgccgaacagcagctcacacaggcggctgagaccaacttttcattataccttgcgactcttgttaccgagctagcaaatgagaatgccccgggtcacattcgagctgccgctggtattgcggtgaagaacgcgttcacagcccgcgagttcagccgtcaaactgaactgcaacaaaaatggcttcaacaaacagacgacgaaaccagggcaaaggtcaagagtctcactctacagaccttgtcgtcaaccaactcccaggctggccaggccgccgcccaggtcatcgcctccatcgctggaatcgagcttccccgtggacaatgggccgacttgatgaacatcctcgtcacaaatgtcagcgagggtcaaccccaccagaagcaggcatctctgactacgataggattcatctgcgagagtcaagatcctgagctccgcgctagcttggtcgaccactccaacgctatcctgacggccgtcgtccagggtgctaggaaggaggagaccaacaatgagatcaggctggccgccatcactgccctcggagactcgctcgagttcgtcggtaacaacttcaagcacgagggcgagcgcaactacatcatgcaagttgtctgcgaggccacacagggcgacgactcacgcatccagcagggtgcctttggttgcctgaaccgtatcatggccctttactacgaaaacatgcgtttctatatggagaaggcgcttttcggcttgaccattttgggcatgaagagcgaagacgaggacgttgccaagctggctgttgagttctggagcaccgtttgtgaagaggagattgccatcgaggacgacaacgcacaggtcgagagcgcggatcaggtcaggccgttttacaacttcgcccgcgtggcaaccaacgaggtggtccccgtcctcctcacccttctcaccaagcaagatgaggacgccgccgacgacgagtacaacatttctcgtgctggctaccagtgtctgcaactttacgcccaggctgttggtggcaccattatcccgcctgttatctcctttgttgagggcaacctccgatccgatgactggcacaacagggatgcggctgtctctgcttttggtgccattatggagggtcccgacgagaagactctggagccgattgtcaagtccgctctgcaaattctcatctcaatgatggacgactcctcggtacacgtcaaggactcgaccgcttacgctcttggtcgcatcaccgaggcctgctcygaggctattgaccccagccagcacctcgagcctctgatccgctcgttgtttgctggcctgctaaacactcccaagatggccgcctcgtgctgttgggctctgatgaacctggcggaacgttttgccggtgagcccggagcgccccagaatgccatcactgcctacttcaacgacagtgtgcgcagcctcctggacgtcaccgccaagaacgattgcgactcggctgtcaggacggccgcgtatgaggttctcaacgctttcatcgtcaatgcggcaaacgatagtctgcaggctgttgccactctttcggatgttatcatcaagcgcctagaggagacgataccactacagacccaggttgtcagcgtcgaggaccgtattacactcgaggacatgcagaccagtctgtcgactgttcttcaggccatcatcggccgtcttgacaaggaaatccttcctcagggcgaccgaatcatgcaggtgctgctgcagattctgtcaacggtcaacggcaagtccactgttcccgaggctattttcgccaccatcagtagccttgccaatgctatcgaggaagagtttgtcaagtacatggatgcctttgcgccgttcctctacaatgctctgggtaaccaggaagaacccagcctgtgctccatggctatcggcctcgtgagcgacattacaaggtcaatgggcgaacgcagccaaccgtactgtgacaactttatgaactatctccttaacaacctgaggagctcaacactttccaaccaattcaagcctgccattctgcagtgcttcggggacattgccaacgccattggcggccactttgagacttatctgtctgttgtggctcaagttttgcaacaagcctccactgttaccacagtacccgagggctcatatgagatgttcgactacgtcgtctcattgagggagggtattatggacgcctggggcggcattattggtgccatgaagagcgccaacaagacccaagccctccagccttatgtcccatccattttcgagctgctgaaccacattggtagcgactcgaaccgtagcgagtctctgatgcgcagttccatgggtgttattggcgatcttgccgatgcctaccccaacggggagctcgtggatgctttccgtcaggrctgggttactrctattatcaaggagacgcgttccaaccgcgagttttcaycgcggacaatcgagacggcacgctgggcacgtgagcaggtcaagcgtcaacttgggggttccgtcaatgtcatgcagcagacttgagaagctttgatatccggttcctaggcaaacggaaatgccctcgacaagtgataaccggccaaggaaaagtcaatccagtcccaacccgccgagccgggcccggtgtccctattcaccaccagcccaaccgccaaactccatttttttgaacgatccgcaatacgaatgcggacaattatcatatggccccttcatatggccggccaaggtcgaccccgtcccatcaagtccctttgactcgcactggaacttgttatgatgcgaatgtcagcgcttatctttttttatttatctgcagacgttcagatttgttggatgacggaatgcacaaccatcactgcccgactgcccgactgcaatagcccccaaagtgaatgtatataattagacccttgaaaaacccctacactattaatttcgagaccacgtccaatcgactttgttgccccttcatacaatcctgcactacctacacactacaccgctgttttttttttttt

SEQ ID NO: 48 - DNA, 4222 bp, Magnaporthe grisae
atttgctacttattaacttgatgatacatcatatgaacacaacaaccttactcgatgtgcaggttgtttattgatacggctcttttttgatggttacgtgttagttagctgacttacctaggtacttcgtagctgcacaccaagcagcctaacactcccttgcagccagtggccatgcagaacaaaaagtttggggcaaaccacaccaaaccggagcactcgggctcatcacgtgatagaattctgctcgcccaaccttgccaacccagtaaagtgggtttcagaacctgttagcccacaagtgaatcaggtcaaaaaactctttcgtgtgtgggagggccgccgtggatctactttggcgacgaacaccatttgtgtctttgacgggagcgtccagtcaagttatttcgctccatcgcgcctgtgacttgcgcctcgtctctgactacgtctaaccttcctttgcgtttagcagacgcctacaggaaaggttgcccatcatgcctcctccaccgcatcaaaaacctgaaaatgtcctcaagcgcgcccatgagctcatcggcgtcaaccaggcccctgccgccctgactttactccatgagcatataacctctaagcgctcccgaaatgttcccatcgcctcgctggagccggttatggtgctcctggttgagctttctgtggagcagaagaagggaaagctggccaaggatgcgctgtaccagtacaagaacatcgcacaaaacacaaatgtcggcacgatagagcttgttttgaaaaaattcatcgagctcgccgcaggcaaggtcaccgccgctcagcaaaaggccgatgaagtccagtcttctatcgaggccactaactccacaagcgtcgacgacctcgaagctaccgagaccccagagtcgattcttcttgcaactgtttccggtgagcagtcgcgcgaccgtaccgatcgtgccattgtcaccccgtggctgaagtttttgtgggaggcctaccgcactgttctcgacattctccgcaacaatgctcgtcttgagcttctataccagagcactgccatgcaggcctttgaattttgcctgaagtacatcaggaagaccgagttccgccgcctctgcgagcttcttcgcaaccacgttcagactgccgccaagtactcaactcagatgcacgctatcaacctgaacgacccagatactcttcaaagacacttggaaacccgcttccagcagctcaacgtcgctgttgagctcgaactctggcaggaggctttccgcagtgtggaggacatccacaccctgctgaatctgagcaagcgcccgccgaagaacatcatgatggccaactactacgagaagctcacccgtatcttcctcgttggcgagaactacctttttcacgcggccgcttggtcccgttattactctctcctccgtcagtcggctgccgtggttgccagcggccaaggcaagaaggctgataacccacctgctacaccagcagacctccagaaggctgcctcttttgttttgctgtccgctctatccattcccgtgatcagcacgacccgttctcgtggtgcaatggtggattttgatgaagccaagaagaacaagaactcgcgtttgacgcatttgctcaacatgtcccaggcccccacgcgtgctgttcttttcaaggacgccatgtccaagtctttactcaaccaggctcgtcccgagatccgtgacctgtacaacatactcgaagttgatttccatcccctttcaatttgcaagaagatctcgcccattcttgcccagattggtgccgatgaggatatgaagaagtacgtgctgcctctgcagcaggtcattcttactaggctcttccagcagctttctcaggtctacgagactgtagatcttgagttcgtcgagagcctggcccagttccccgagccgttccaggtgactcgcgcaactgtggaaaagttcatcatgaacggcaacaagaagggagatctttcaatccgtatggaccatggtacaggagttctgagcttcgacacggatatcttctcatcctccaaggcgtctcactcaggctctgcggctggttcggcagaggccgagggcggttccgttcagagactccagaggactccctctgagattgttaggtcacagcttgttcgccttggccgggccttgtatacgacatgctactacgtcgatccctcatttaacgagtctcgtgttaaggcccgcgaggctgcattggcgcgggccaaggccggtgctgagaaggaacaccgtgagatcctggcacgaaaggatattatccagaagcgcaaagaggaggcttcggacctgcaggccaaacgcgagaaggagaacgctaagatcaagcggatgcgtgagcaagcactcctggaggcggagcagcaacgcctggcggaggagcagaaggagcgtgaacgcaagcgcaaggagaaggagatgcaggagatccgcaagcaggaggcagagagtctcatcaaggatctcaagattggtcccaatgctctggatgtcagcgccgaagacttggcaaatctcgacacctcgcagattcgcgccatcaaggttgcccagcttgagcgagagaagaatgatatcaacgagaagcttcgtattactggcaagcgtctggaccacctcgaacgtgcgtaccgcaaggaagaggttaagaagcttcacgaggattacgagagccagaagaagcgtgatctggatgcctacagcaagataaaggaagagactttgaaggagtccaagatcaagcacgaggagagtgtggagctgaagcaccgtctcagccgtctgatgcctttctacgaagaattccgcgccaacctgcaggagaggcgtcgggacgagttcgagaagcgccgccgtgacgccgaaagggagctcgagaagcagattgctcaacgcaagaaggagtaccgcgagaagaagttgcgcgagaagaggcagcgggaggaggaggagcgacagctccgggaagccgaggagcgtgctgcaaaggagaaggaggagcagaagaggcgcgaggaggctcgcaaggaggagcttgcacgtgccaaggctcaacgcgaggccgagaggcaagagatggccgagaaggctgctctgcaagcccgcagagaagaggaagccctcgagaggagaaagagggaaaaggagaagttggcctcggcgcccccggcatcggccgcgcctgtcagggcctcggagtctgctggcggcccgcctcgcctcaacttggctggtgcaggtggcaagcccagctggcgtgacagggtcccatcttcaaacgtcggagccgctccctcggagcgttctgagcgtccctcggagcgccctgctcctgcccgaactggtacccccatggagcgcactgattcaaacgatcgtgctggtggtccgccccggcttaaccttgctcgtgctgacggtgccaagcccagctggcgtgaacgtgagcaggccaaggctagcggtggccctgagcgggatcttcctcccagcagggcggcttctggaaggggcccaccgatgcacaggaccgattcgggccgtggagagaacggcagggacgagtcgccggcgccccccagagattcattgacggcttctggagcaccaggcaagtacgtgccgcggtggaagcgtgagaatgccgggaactaggttctcgtcaaggacaaaaagcaagcaaatagttcactttttcctcgttaatttgcattgggagtttttggtcttttggtcgatttggtcacgatagtcgagctggtctgtattctagaatcaacccgtctggctcgctttaagctgggagtggggaagttttgcgagtctcgggagcctagaacggagcagtgggtagacggatactgggggtggatataggtcatgtttggcaccgtgttcaggtttcggtccgtcaccatgcgcaatgacaaaattcattcacgttatttctgctttctgtccttttttgtgttggggcggttcgcatctgggatgccaaccttgaaccgcaacgacgatgagttttatttactttcgacaggaccacagtcatgtttgttgtcggcaacatgtgtgagaaaaaaagaaagaaaggaaaaaaaaagccattatcatcacattggtgcccgcccccctgtatgtgtgctaggtgtagc

SEQ ID NO: 49 - DNA, 3508 bp, Magnaporthe grisae
tggtttttttctggggcgcgtttgtgtacgtctgaccgacgaacaaagaacaccccactcgctcttccacccttacacaataactttggggtcgcctttggcaagaataaatttgcctaacttacttacgcaaagctcatcttcgtcgagatttacatatccgtaattattaatggttttttgcgtctaatcatcccataaaacccgtcgacatcgaggcgccaccagcctggtcgccatagcaaaacgacgtcctcacgcgcccgaacatagacacaggcactttggtcgcggttttcggtcgcgtaaaacctggcagaagcctcccgcggcgaatacagagcgacgaacccgaagcgcgtttgtcggccttcgatttggggtggcaaaggtacctttggtcctgagcctcctccttagcctgatcccatggcttggcatgtcaggtagcagtctacgagcatagtcgaatgtcacggcccttggtacagtccgctgccatggcacctggtagcagtggtgccaatgtcgcagcactgttacgacacgcagtgctataccacctcgacaacagtgcacacgaaaatgcgctctttttcgccgaaagactcgctgctcaggaccctcgatcccccgaatcagcgtttctccttgccctctgccatttccgcctgggagattttctgtcggcgcacgatgccagcaaggacgacttgaagggagcaggccttcggagtttacatatagggcgggcctacatatttgcgcagagctgcttggcactagaaagatatcgagatggggctatcgcactggagaggtgtcgaccgcaatggccgcataaaaccacttttgggaaacacacggcctccacgcgcagcctgatacctgatgctgccgcgctaaactgcctgcttggtaagctctatcaggggcttgacgacaagaacagggctgtatcctgctttgaggacgcactgaagctgaaccctttcatgtgggatgccttcacatcgttgtgtgacatgggtgttcacatcaaggttccaaacatattcaaggtcaccgacaagcttgtgcgggctcttgattcagaagataaacccacgattaacgacaaggaaacatcttcagcagctacattagagccgctgccgagaaagtcagctttgcgttcggcccccgcagacacctcggatcccttcgaccaaccaagagcagtcgccttccaggacagacaggcactcgggaatctggtagccgccgagaccgaagaaaatgagtttctccaaaagatcgcagctgctcgctctaggatggcagcagcttcaggaccaagcagtgcgagtgatctcctagacactcctccagctccttcggctccggtggagataaacgccttgcgtggaggggctcatcctgagcctccgcacgcgcccatgcgcaaaactagggcagcgcatactattgaaccacctccttcggatgccccgccaaggatgggatatcgtggcatcactaaacgaagagcaaatttggaccccaactcagaagccccttcagccacggagcagcccgyttcccagatgctcagaacttcagcgtcatcactgttgggagctgaacagcggaagcggaccatatctgggcatccagtccaatccaggccaggtgttaccgaagaacccggagcaccacagagaagaagtgccaggctcaacatgttcaagcagccctctactgccaagccgaacgctgcagctgctcccattggcaccacatctacgagggaaatgaagaaagccagaccagccatctcgagaatcatgcggccagggagtagcggttctagcgttgggagggttgtgagtgggaaccgaaagccagtggaggaaaataccatggatgttgatcatgtcgagcccccgaagatgagagatgcagttcaaccacctctaggacctgcaagaacaatcgaggcggacggacacagcacagtaagattagaagaaaccttgcggttgttgatggatcttctcaaacgcctgggaacgggatatttggctttgtcgcagtaccagtgcagcgaagctgtgcaagctttcagcacgataccgcgagctcatgtcgacaccccgtgggttttagctcacatcggacgcgctcagtatgaacagaccaagtatgctgaagcagaggcctccttcaagcgcttaagaacattggcaccgaatcggctggaggacatggaggtctattccacagtactttggcacctgaagaaggaaacagaggcatcgtttctggcacacgagcttgttgacatagcgtggcattcaccgcacgcctggtgcgccttgggcaatgcatggtcgctggcatcagatcgcgaacaagcgctgcggtgcttcaagcgtgctacgcagctcgacgcaaaatttgcatatgcctacacacttcaagggcatgagcactttgttagtgaagaatacgataaggcgttgacatcataccggcacgccatagcggcggaccggcgccattacaatgcctactatggcatcggaagagtgtacgagaaacttggcaactatgacaaggcatatacccacttccatgcggcctcagtgattcacccgaccaacgcggtcctgatatgctgcatcggtacggcactggagaagcaaaagcaagttgtacaggccctgcagtttttcacaaaggcgaccgaactagcaccgcgggcagcgcaaacacgcttcatgaaagcgcgcgctcttttggcgttgggacaactacacgaggctcagaaagagctcatgatcctcaaggacctcgcaccggacgaggcgactgtgcatttcctgcttggaaagctctacaaaacacttaacgataagaatacggcggtccatcactttacgattgcactgagtctggatccaaaggtaagccagccgctgcatgtcaatgttgcttttcttgggctacccaacggtgatggctgacaaccccgaacaggccagtcaattgatcaaaaaggccatagaaagtctcgaggatgatgaatgttatgacgactccatggtgcaatgacaataacaataacaatgttgcccaagtgtgggcgagggtaacggctttctctctctagaacttgctacgaatgtatataaccgactctgagatgaaactcttcacccgttagcccaattggccaccagggaaatcagtgggacgttgttgcatggcgtctatgaaacgacacgagaagatatgaaccatcgatcatttcaatccatggaaatgcagcattgcattggcgttctggacatgctatttgctgggaagcaagcaatttgagattgtttctggccactgagttctggggagagccatgggatgggacgggagggcgcctggatcgggagatagttgggtaaggctttgactatgcggttgtgtttttggggaagcggtctttatttttattttttttgggcgtagg

SEQ ID NO: 50 - DNA, 8728 bp, Magnaporthe grisae
agccaagccagttcaaggtgccaaaacccaaaagaagaggagactgccgagcagatagcattgcgctcttgccatcagaaaaaaaaaaaagaccaagggtgcaggctaaaatcaaacaactgccatcctgtcgtgaaaagaatgcccgaaactattgatgcttttggctgactgcttgcttgcttgcttgcccccttccaacagctagcctcgtagctagctgtcaaaagcaagcaagggattatttgtgtgatattttgcataccagtccgaccgaccgaccgaccgacttacctaccacctaaccttccttaccttattcacctacatttaatatctacctacctacctaccgtcctgattcattcccttgccaaccgcctaatcaaacaccgacatcactgcaggctgcatgcgacgtgaatgcgctgcagcagcagtttttgacagtatcaattagacaccggaccatgtgagggagctccaagcccctcttgaaaatggctccgtcccagtcgctgccagaccatgcgcccagcccctcgcccaatttcacatcccgaaccgtgacgcgacttgacgaggaaaacgaagagtacgatagctatgaagacttgggcaagacactaaggccgcttgcctttgaatttcccccgaaccgccgcctagccacccattcacgcgactcatccattgaaaagatcactgttcagctaccactctcaccgccacaaacgcaacaagtcgcagggtccacctcttcggcggcctccccggttgtctccccacgagcccatgcttctgccgtgcgatcggctaccggtattgggggcgtaatcgagcgggccattgacccgaaagctgctgcatacggtcaccaccgtcagacctcgatagtccacggcatacaacattctaggaatggaagccacgccagctctgtatcaagtccactgagcccccagattattgccgctgcgggagcatccttagctttagacccgcccgacatgcacgcgtatgccgtttcgacgtcagatatcgactccccgttgggttcgaggcccccgacggccgcgtcgaccgggtccaccctagtgaacagtcccgttggcaccgagagatcatcggctgccacagatactaccgctcatgcgccaacgccaagacgaatgcacagcggcaaggccaggagggaccacacgcaaaatccgtcgcactcgtcaaggcaccacaaggaggagcaaaagactgtaggggggtacgccatgcatgtgctgttcacttctttcatcgcgcacgcagaagagaaactgaacgaatgtatcacgccgccgtccgagcccgagccccaggtcgaacaaatatgcggacctggggccgacgaatcattcgatcggctgatcgttgcattgggccatatcgccagacaaaagccgaaacctttgatcgactcgatgatgttgtggaggaagagcaaaagcgatgccgcgagtgacgcgcgcaagcagctgcaaatgtccaaatccgtaccgcccagcggtcctctcctgaggagaaacacagagccactgcagttgatgtcaggccctaatcctcaagaccagaacggttccatatcgccatcgcctctcgcagcgaagcaggagtatgttgtgcaaacagaaagacggtcaagcgtctccacctatctgctatgccgtgtcctcctcgaggtcatcagccaaagcagtttgagtctgatcactcctgaaatggaagacaagctggaagatattatctttagtcaactcaaagtagccgacccggagcaacttatagaatctcctctcaagcttgccaactggaatattttcgcccaacttctcggcgtcatgagcgaaatcaacttcacaagcgtgacaaaccgcttcattcaagatctggaacgttccctgcaggagcttggatcgagaggatccgccttgccctcgcgagaggagacggagggaaggatagagctcgttcttggggggatgaagcatttgaggcttgcgttgacgcctgacgacgcgtgggaaaggtcgtgcgaatttatgagcgcacttggcaggctgtttgcaaggtcacatggccaaaagatcaagtcgtccttctgccaagtcttggagatgctgctgctccccatcgccgggaaggcaacaaacagccagttcatgaaaccccaatgggctgaagtcttgagcaatgctggccctcgacttgcgcaaatgtttgttaagccacgccattggtactgctctttccccttgactgcaacgatgctctgtgtctcgtcgccagagacgttctctagccagtggcttcagttggtatatccgctgcaaccgaagctcaaagatcgattctccaagccgctctgtctgcaagtcgtgtccagacttgtttggacatatctctaccgcaccaacgaatccccagcttcaaccgtacgcaagttggatgaggtcctcaagctggtgctcccaactgcaaaacgcactatcaactctgccgacccaactgtgtctgagcctttgatacaaatcatcagaatcatcgggttcaaactacccgagttctgtttcaaaacaataatatttccgctgataaacgcagaccttttcgcaaccaacagggagctcaaagtggatagcttggaaccagacaaggttgttattggaatccgagcatttttggccgtgatggcggatctcgagaagggtgaccagggaaggccaccgttcccccaacagtaccctataacatctgtgcctgaacgcgcctcacaaacaccgatagctaacgggtcgtcaagcccgccgacccctggaggacccttagatggagtggaggacgagggactcgcgcgccgcgtgttgacgtctactctcagcgagtctgtgaaggagtactacaccaggttttgccaaatattgggcaagattactataatgtgtgacaacacctttggaggccaggccgccctcgacgaaaagttcaactcgcctactcccaaaacacctatcgccgacaccttcaactttcgccgcgatgagcaccaaaacccgacagatcagaaacaggccttctacgagctcctgcacgtggccgtccaggcattaccccgctgcctatctcctgacattcccttcaactcactgattaacctgctgtgtaccggaactgcccacgtacaatcaaacattgcagagtcatcggccctgtccctgaaggccatagctcgccagtcacatgcccaacaagtcacgatggggttctcccgctttatcttcaatttcgacgatcgatactctaccatgtctgacggcggcatgctgggggctgggcacattgagaatactctgagactatacgtcgagctgctgcatatatggatcgaggagattagacataagaccaaggaagcaacgggtgcagttggggacacaaacgcctccgataagaggggcatgaaattagacttgtccagcatatgggctgaagttgatcaagctgaggcacatggactttttttcctctgctcccaatcgcgcagagtccggtatttcgccataacggtgcttcgtctcatcaaggagttcgacatggccctcgggaaagcagaaagcgatgatgagaaggaagccgtgagattgatagatgtcctggagaaggactacgtacaggtcatgacttttaacgatgatcatctgtcagtggcagagcgaagcagattgcaaagagggatgcaagacaacaacagccaaggcctgattacgctttgtgccagcgatgtttcctacgacaccactctctggttcaaggtgtttccgcatctcatcagggtagcttatgaccgatgccctttcaccattacgatcggccgggacttgatttgcaacaggatattgcagatgtacaaagcgataaccatcatttctgagccgtccagagggctctactacgggtcggatcccggaagcgcccgtctgacggggaggacgccaacgacacagcctgagctgctggtcgagcagtggaagctctatcttgtctttgcgtgcacaacaatggcagatcctggcagcccccaacagccgaagcagccaccgcctccccaggcagcccagcacggccgaaagggctccaacaacaagtctctatcggcagacaagattgtcacggctcgcactctcttcaaatacctgaacccactcttgtcggtgagctctgcgtctgtcagggaagctgtcgttgtggcgatggggtcaatcaacattaatatctaccgcacgctcctggaagagcttcaggggcacgtatcgcgatgcaacgacgaagccagggctcgtattcaccagcgtaccaatagcagccctcgtcgcaaccgcaggatggatttgcttaggactgaaataactcatgtttacaagctcacctctcacttcctcaaggatccttcggtaatacaggatgactggatacttagtaacctggtggcgtattccaaggacttgaaactgttcttgatggatggagaagttcagatggactgggagtttcaaaaattgcggcgccactactgtggcttggttgaggagatcttcgaagggatcaaaagaaccaaggatccgtcccgctggatgactttcgaggctcgcaaatctgcgtttgcactcatggaagattggtgtgggttttcgcccaaccacaaccagatccgacatcgtgaagatacaatgcggcaatccgttatagagcaacagtctgctggggagcgcggcacactgactgccgcaatggaaatagagaagagaaatctcaggactgcagcactgagcgcgatggcggccctgtgcggcggccctataagtgttactaccgaaagtggcgtgtcccttcagttcgacctcaggcggatgctcaactggatcgagtcgatattcactaccggcaatgaccgcatgaaggtcactggcaggcgagccctcaaaaaccttctcgtccacaaccaggagtacccgtacctgctggaacactgcatcatgcgttgctacctggcaaatgtccccaaggtgctagaaagctacttcagcgtcagcactgaggtgcttctggaatatcctgagtatccagcgtctttctggaaactgctgcccctgtgcctcttcactcttgggaacgaccagagcgatatacggataaaatcagctcgcatcctcagggctctcgaggagcggcagcaaccaccgcggtcctccaaaatccaagactttgatatcagcatctctgataagaccaaggcagtctacaagcttgcacagtataagatctcggagcgtctctctaagcagtatacggagctggcattttacttcttctcgcagctttcactatatttcaaagacctcgagtctggtgcgcaaaggaacatggttgctgtcatcctaccgtggatccagtcaacagaactgaaggtcgaccccaacggtggcccggtcgctcagtcatatatgctcttggccaacctactggaaatcacaatcaaggccagctctgctctccataacgaggtgcaagctctctggcaagcgctcgcgaccggcccccatcctggcaatgtacgactcgttcttgacttcataatggcgctctgcttggagcgccgggagcaaaactttgttgaatatgccaagcagatcgttgtctttctcgccagctccaacagcaaccctggacagaaggttgtcgagttcctgctgtcattcatcacgccaaaaaacatggtgccgaacgaaaagcgggacaccccccctccacctccagacgttggacttctcccatactgcgccgacttgtccgaggctctgcctgttggtacaaaacaagctggtttctcgaccggtcaactttcgatgatactactcgtagacctaatggtttcacctgtcaaggtggtgccggataatgtgcccgtgctgctccaggtggtgattgttctttgggaccactacacgcccttggtccatgagcaggcccgcgagatgctcgttcatctaatccacgagctcgtcatatcaaagctagacgatgcgacccctcagtcgaaaaagaaggccattgaggatctcattgatctgattcgccaacatgacaagcttgtaatctggaactatgaggatagtaacggcaaggccgaggacgatgggagcaacgtcccacccagcatggagtatctcgccgccgaagtagtcaacacatttgaggttacctacccaggcatcaaagaccagtgggctaggctgtcgttgatctgggcgacttcctgcccggttagacatctcgcctgccgctcgttccaagtcttcaggtgtatacagacgtccgttgaccaatacatgctgggagacatgctcgtgaggctgtccaacaccattgccgacgaggatcccgagattcaaacattttccatggagatccttacaactttgcagaccataatcgcgagtcttgatgtcgacaagctcctcacctttcctcaaatattctggaccacctgtgcctgccttgaatcgatcaacgaacaagagttccttggcgccgtcaagatgctcaatgagtacttggacaaggtagacatgacttctcctagcccactcctttacaaaggcctacgatctgcggtttgccttgatgctacattagcaactctcaatcgactagtgcccctgccgagcgaccccttgataggagacgatagccgcgtctttttcaccattctcgccaacctgccgcgattcttgcagacaatggaccagcctcggcccctgagtgagcctgtcagcaagaccatcggggctcttctagatgttgccatcgaagagggacattcacccgtggctctcgttctgaatggcttcctgtccggcaactatcggaatggcaccgagctcgtacatggcgtctttgcggcctttaaggatacattttcgacgcagctcgatttcaaaatgattactatgattatgggcttcctcacaaatcgcacaccctgggtcacgtccaagacgctgcaaattctcaaggtcatcatctcggagattgatatgaagcgtcctgacattatagggcatggctcggacctgctttctcctcttctgaggctgttgcagaccgagtactgcatggaagctctcggcgtactggacaacataatgaacatgtcgggctcgacaatggacaaacagcacttgcgcatgagtatgacgcggtcgacattcaaggctatcaggaaggaatacgagcgagtgcagagcctgtttggcatacccgaggaatctggctgggcgattcctatgccagccaagaagacagaaaccacccgggcgaacgtccatgccgccttttacatgtgccagggagccgagggtatcgttaccgatgtcatgcccacccccgaagtcgagttccacgccgacgaatttccctacggctacttcccaacatcctatgaaaggaccgagacaatgttgtcggacgaggctcgtggggacggcaacggaggtgacgtggtcacgaagctagatagcctcgatgacttctttgacgatcttagtatgagcccacccagcgaagcacactcatcgaatactataaccgagtttatcccggataacaactatgacatggaggcccagctgtacgatgagcaggtccttcccatcctccaccaagcttcgactgccagctcttttcagaacggcttcgtcgataggcctgcgccattgtcgagagacggttactctaacacaatgacacctggagcgttcagtttcgaccaggaactgacatcgaccacgcgcccagggctgcactcccggagtgtgacctcgccgtcggctccagcatcataccagcctcatctgggagaggccatcgcatctgatgatgagctcttctcggacgacgagcgctccaacgccggtggcgcaccgcccgagggctctttcttcctcgagaatatggtcaagccccttactcaaagcactcggactcgcattagacgcttgaccggcaacaggtcgaaggatgaacgacagcatctagatatttcccgtcccgaccgcccaggccctcctcaggtacccaagcttcccagttcatacctgcccaaggggtccccgcctggtagtggggacatgctttgaagatgatgtttcttcacacctcacaacagcatatcctgtcgattacagcatgcattcgattagacttttaccgtcacagatcttttcaattttgtttcaaagataccctcgctaattcatgatccatttcccctctatgttttgtttttaaaagagcgcagcatcatttggggctttaaccttttttgcgttggacacaatcggacttttgttgcaccatgtatccaaacaagtaatacagtctagctagggatcattcacatggcagaagagcaaaaatacgagaatttctacatcgtgcccgcagagttgaacaaacctttgaagacagtacacgacccaaaaaggggacgaagtttggcaagactcgttggcttcaatatagctcccggaaatttcactgcttctgtaatgtaggtgatcatatcagcaatctttgattcttctgcgttaaaaaggccatgttcatcgtaaaaatcgtcgagaccaacccttgacag

SEQ ID NO: 51 - DNA, 5999 bp, Magnaporthe grisae
tctccaactatcgtacaaaaaaagtgagacgagattcggagccttgcttgctctgcagatacccctgtttcccactaccaaacagaatgaacaggcagggcggctacattaggcgtgctttccccaaaaagctttgctgttgctcaggcggcttgctatggctccaagctttacagtaggccagaaagcccgagatacttgaggcgggtacctaagtggggacaagtgaagcttttgatttgccgacacaataaaaaaccccacccaagctaccttgcccattcaacccaaacccaaatctgaagaaagtcttgtcgcgtctggacggcgcgcgtttttgcagaagctctccgcacgacgacgtttgttggacgatcccccccagagctttccagagcgcgcgcaaaccggaggccaggactcagctcatatgcactgggctctcgtctgcgcatttcaaactcgcacgacaatgcgccattactaaaagcccgcccaccatgtccgaagcctatcttttagagacactgcagtccttctatggcgatctaatcgcaataggcgaggggcgcctcaatggcccgtctctggagggagacgagctgacggctctcctcgaaaacttcaagaactttcttgaggagccaccaaagcgagacgctagccgaaaacaacttgagtccggcaagattagcgtgggagacgtagaatactcgatcaacaaggagttccaggaatatagcatacaactcgcagacgaggtaaacctggatgaggtcgaggcggccaagctgctcctcgaggcacaagatagccagatcctcctgggaaggtcgctagtcgagtgcgcgctcattcggttccaccaacgacgaaaatacctcctagattgtatacgactatgtatcgagcttgcgaatgacgacgagaacgaatcgatcaaggcggtcttcgaagaaattgttgcacgatatgtttttgacctgccattgccaggtgctccggccgcggcggttccgaaggaaaagaaagtagtgccacggtgtatggcagcaatggccaagatcaaagactggctcgaaaaactggccaacaagatcatgctggcaagaatgcacagcggcacggctcctcctgagatcgagaccatcgagttttgccgcttgagtctagtgcagcaacacgagaacttggccgtcatcctatgcgctgcggttgagcaacgtcatgcagaacgcacaaactttgaagagttcatccaactgctgaagaaggccgataaatacgaccacctcttagtgcatcttttccccgtcattggagcctatattcgtctgtatggatcgactgagggctggggggatctggttattgccaggtctttgaaccaaaaaattgtcaacgacgagacgtcttggtccttgccgtttctgtatgccgctgttaaggtctggtggattgcagagtacagcggcttctacgtcgagggtcctgtttcggatcccagcattgacattgacaaagaggataaggagagaaataagcagttcaccgacgctctcaaggagggagcattcgacttcatgttgtcacttgcaggggatgttgctgcccctgaatggcaagacccctctcgtattggaatcaggcaatggctccagcgaaagtcaccacaactgatgactgattcaacgccattctccgactacttccacacgtgcttgatgaaccagcttgaagattttgtggatgcttttatatcaaatcttcccgatgttcttcggaaacttaggaccgaggaggacgaacaacggcagcttagccagcaccatgaacaagacttggatctggaaagattcctggtcatcatctcttacgtctttgaaagacggcccgacgcagctgacgtgttctggtcggactctgaaagcaacttggcaggtttcatgcagtgggcatccaggagagcatccacgccgctcgtgtgtgctttctgcgagatgctgcagtccatcactgagaatgaacagtacgcacttgctgctcaccagttcttgttggaggacagcaatgccggagggaaaatgagaagatcacagtccttgacatgggctcagattttcaaagagttgcactacttcaccaagaaaattcgtggtgaaatctctagcccacagcaaattcacgaataccgaacgcaaaagccaggcgaggacctagcagaaacggaaccggagtcggctatgctgctggagtgctatctccgattgatcgcccgacttggaagtcagagcacagcggcaagggagttcctactcaggaaccaagacttccccttggtagatgtgattctgcagctgaacagctgccacatacctcctaggctgcgtgcctgtggcttctatgccattgcggcactagtcaggcgcaaagaacaagacgacagcaataccatgtggctttgcatagacgcctttgttagtggcggctttcaagccgcgagcaactcccgtggattgattaagggacaaagccacagctcagccggcgttgttgatagggtattggacgagctgagcaacggtttcgaggaaccaagtgcttttatcaacctgatcaacgctttagtcgcgccagcagatcaagcaagtctcctgcgagatgcccttcctttccccgagaaccttgggtctagcttacgaatgccggggattgagccatacgttgactttgttgtgggacatgtcttcagcctcaagtcaaaagagctccaggatgtttcgcagctgagagttctgcgagtgagctgtttggagtttatcttgctgtgcctaaacacgttcaacgaagatcttatcattcttggtaatcagaccaatgtctctgtggacttgatcattgccacatcagacctggccacatatgtccgccttcacccattcgctcgggtgatggaatggatgttcaacggccaggttgtagatgccatatttgaaacgatacaccaacagtccagcgatatcggaagcgtttcgcccgattcgcccttgatattgggcattatacgagctgttgaggtggtgtcgaaagttttggagcttcaggacacatatgttgatcttgtgcggcaagtcataaaacagcacacaggacaacgccatagacatgtgcctcacgcttcctacgcctccttcgaagaagggtttgctcatcacctcgaggtcgtcgcagatctcggccgatattgcggcctcggtcacccagagctgaccatggtctgcttaaagcttctggcacggatttccacttcatcgaaactgatatcggcgtggaacaccgagccaggtagacagtcccaccgcaacaaggcggtagtggctctagaaaaagatggggaagcggattctatttccggatccctcattgccgagcttatcgtgccccttgacctggctcgagaggctgactctccaaactacctaatcaagacttacattctagacttcctctacgcatgtttacgagcatctccagaccaaccaactatcgcccatcttctactcggcttcaagtgcggcgtgagccatttgaaagtcgagcccagaggccagttcgaggaaaggacgtcgctatttcacaatcttctcagggtattgctggagactccttttggagacgaggagctaggaatgaggacatggcttgtggcattaaagcgcaagttatggggatactgcagattctttggagttctcctctgtcctcggccattgtcttggaagaactccggagcaacgacgttctattccatattctgctccgcgaggagtcaatacagctgatctgatgtgggatggagtgagcatggaggaacgcggattcctactctctgacgcagccgtgggtttttcggagttcctggctacgaggcaacttaccttcgattatctggccatcgagttatgcagcgtcacccagaggcgcctccccagcttgaaacgccgtatctatgacgcccttaacggacaggtcactactgccaattcggacagccctcaatccatacccaccatcttcgatttgtacgattttatgcctgcggacgggcaatgggagatccctctacctgagttcacccatttcaaaggcgaagaattcagtatgtgcctggaaggagcacatgactctgtgctcatgtacaacatggagcgggtaaaacaggtgattgcattgaagaggaggcaggatgctcaaaatggtcagatagctacggctgccgacctcgcttccgtggaccgggagcaggttattcttgaggaatacttggtctaccacaaccgccaagcagcagtcagttctgagcgacggaaagtgctcaaagcctgggttaatctgctcatggtgatgttcgaggcgagcgatcaccagggctcagcgaaggttgctttccttttacaagcattgcagacgatattaccaactcttgagtctttcggatccgaacgtccgggtgaggcatttgagctggcgaaactggcaaaagttctcctcttcaagctcgacatagccgctccagacgcagaggacaaggacgcacataccgtgggcaacctcatcagcgagaagctcttccagttgtttgaggtttgcctgtacgccataggtaggcgaacgggcagtgcggaacttcgatccacgtactatgccatctgctaccggtatctgataggtatcattgacgatggaagagatttcgtgcctggccgcaggaaagcgatcaaggctgttcaggtctacggcgagcgcctgttgaccatcgtctgcgacgatgcatttggcggcgatgcaacgtgccaaacttctgcgttgatcttgctaggcgctttgacgaacctgggtcgacgagaggacgacggtcaagtggtggaggctctcaatcgcctgaactttattggcgtcctcgttgactctttgaagacaatcctcgatgatgtgactgcggcccgtaaagcaggaaactcggaccagcaagaatcttactcgcacgcaaaattggcgcttctccttcagctctgccaaacccgcgatggagcaaagtatgtgctgcaggctaacctcctgcgcgcaattgaggtctctgggctttttgcggcagacccagagctccagattgatcggagcgacactaaagccttggcggaccattatgacctcctaataagggtgatgcgtgtcatcggtgcggcaatactgagtcgcggcgcgcacaacgtcccgcaaggtcgccggttcctgaccgagcaccgcatgcttgtaatgcacgtcctcaagcgatccgctggcatcgcagccgtcgaccagaagctggaggcgctagttgttggactcgcggattccttcatggtgctgattactgccacagagtttttggagtttgaggatactcaagggcggggtccgcaacagcaaaagaagactggcccagtcctgtttcattgagcatgaggcagtcagatgcccgatgataacgactggagtagaggcagcgttgacattttgcgtaaagccgcggtggaagaggaatgtgtccttggcggaccgttggagttgtcagggatttgtatacacagataaaatagacaattagcgtgcatgataatgggatcaggtgtactcaaaaatttcatccaggtttacaagctcgagtccagcgggaataacgtattagtccctcactcaaatcatgcgttgcgtaccgcatttcacaacaaggagatcaaaacctgcgctagaggttgtaaatgatttcacgcccaatggtctcaatgattagagggtgagaataatcgctaaaaacacataaaccaccaatgctccctgggtatatcgtctaatgcaaccgttgccgtatggcttcccaatcgggttcttccgggaccagagacctctgacaatgagccccaacgccttgttacaacacccaatagagaaatgaaaag

SEQ ID NO: 52 - DNA, 5317 bp, Magnaporthe grisae
gttgtggaggggcccgggttttgtaccgggtttcaatgcagggtaggttagaaacggtgatgatgtggggaggggcgcccgagtagatgttagtgctactgtgtacttcacacagtactgacatgcccatcgtcgcggaactagtcgcatgcacgcaattcatatcttccaggcgtttgtctgtctcggcaatttgatcctagagaccaacaaggtctttttagctgatcgcgcagttattcttttaaactcgcagtcaattgtgtgcccatgctgacaagcacctcgctgtcgcatcggtgattgtcaagcttactgtagctccaagttccaggacaagtacaccgccgaggacacgactaaagacgggccccgaagcttatctggtagctttgcgtgtcttgagctgcagacatatgatgcgacggcccgctacgtacctgcctataaaagtcgaccgcgctcattagagacaaagaaggaatgacagctccccgaggatgagcgcggatcctctgttacccatcgctccggcgagggtaaaggccctggtcctccccgtcggccaaatcagacgccagcgcttcgcctcctttctggataggctggccgccgaacaggtggttcagctgcgcgacatcagcccagatggccggccgaacaggaacatgttctcgcccctggcgttccccgacggtgccatgttctacgagctcacgacccactacccgcacccctcctacttgaccctcacgcctttcgacctctaccgcgagccctttgtcgtcattgctgttgctgacgcttccgagatcgaccgccatgccctcagcaagaggcagtcaggagggggtcggaccaccactgaaagaaacattaggggcttgtaccaggacctggaggacctacgcgaccagttcccaaaggtactcgtgcacaggctgttgctttttgactacgtggagaatcccgacgaacacgttccgatcccagaagacatcacgaccataccgccaccccaggactgcaagagaacaaccatgaggacggtcatgtgtgacatagcgtcacagctcctggccgagatgacctcaatggcaaagcaattcgaggcactctcttatgttgattccccaggccagatacccacaggacagccgaatggccaggaccctatgcacgccagacggaactcgcagttctcgttgcctggggggaccaacggtggacgttcgagctcagctgccgcaaacaaccgcatgtctatgcctgtgctaccaaaaggttcaggctttggatccgccggttcgacgccgatcaggccatctacgccggtaaagagcgggctctcaaatacgccgaatctggacgatggctcatcagagtttagctcgggccctccgacgccggagcaacccaatgcagtacggcctggtaccaatgagaactttaggacagtcagtcaggacaggatatcagtgcaagggtttgggtccggcgggctcaacgagaggtggagaagcaaaggcaaaggcagggtgaccatcatcctggggtcgttatacctgcaggcggggcgatggccagatgctctgaaccacctcaccgagggcgctaccgtggccaggtcgattaacgatcacgtttggcacggcaaggctctggagctgatcgtgatatgcttactgctactgggctgggctggtgttgagtttcaggtgccctcggtgctattggcgccgacctcggaaaagacttctgccagcgcagcagcggccatggccgcagatgagaagaacgcaagtccaacccagccgcggtggtttagaaacttgcaggtcatcctgcctgacctgctagaccgcataattgctctatattcaaggatatcagctgagcatctaccccccttgccaatggccgaggctatcatcagatgctccaggaccttgactgggcttcacctgactgatggctgtctcgaagccgacacacttgggctcttggttctggggcgggcgccgaccaaagtcttgagctcatcacctcggctgaccgtgactccgtcccgtacactcatcgtcaacatgatgttcaaggcattcccaaactcatcaaccgagatgctgagcgcggtcgatcgaatcgcgattttatcaggcatcgcatctgtccttggcatgctaggctatcagaggaaaaaggccatggtcatccgggagcttgtctcagtattgatagggggcctcgttgaagctaggacgcgtggtgcggctgaggtcggcattcaccctgctgcagggctcgctgcattgaatggcgtcagcggccacacgacaggagctgcagccctggaccttggagagggcgacattgaagaatcgatcgacgtttttctaggtctcttgctcagaacatatggcgtggtctcattcgaaatggatacactcgtatcaccaaccaaagatatggaaactgctcatactgacgacggcgcagtcgttaggatacaaaaacaggcagcggcaagattctttggtatacctgcgctcaagctcaatatcctcagagcctgcataaacttctctgaggcactgccagactttaacggggtgctgaagtattcgagtgatctgctgcggactgcaggcagcggtcttgcacctgggccgcggcgtgaggatgccgcgcccataatatctagggatgaacaggtgcgcctcataaccaacatactgaaaacatctagcctctcccagcgtcttggcatgggtgaaatgctggccgatttttgggacgaattcttccttaggggtgtcaagctcgagcctctgccccggacgcgggcaacgattgagcataaaaagagtgagcttgcaggtgcatcgacggcgcgcgaatcccaggacgttgatcctctaattcacaacccgttcctgaagccgcccgacaaggcagcagtagaaagtaccctggttgcgttcgagcccgcgactttcaaattgactttacaaaatccgtatgaaatcgaggttgaaattgaaagcgtgcggttagacacggaaggggtcgagtttgaatcctctgtcgacagcgccctcattggcccatatcgcacgcagatacttcgtctagtcggcataccgaaggctgcggggtctctaaagattaccggcgccatcatcaaagtcaggggttgccgagagaggaggtttcctatattcccgagcccttggtccccagaagaccaaccaaaagtcaaagctattgggctggcagctttggaacagcatgttttggagccggcatcccaagcccccaagactgaccacatctcgctcaacgtcatagatgagcagccagttgtggttgtcaagtcgacttcgttggcccagtcttcggttatgatcctagagggtgaaagtcaagtattctcagtcacactgcagaacctgtccaagacaaccgcggcggactttttgttgttttcgttccaggattcgacgcaggagcctttgcaagctgcattaagcaagaggaatgccacccctcaggagctatacgagtacgagctgatattggcgcgaaagcaagctttgcgtctcaagcccagagcggaccacaagaggtatattggtcccggagaagaggcgacgtttgatttccagatcctgggcaaaccggggcttaccggcggtattatacaagtggattatgcgcaccttggtgtaccaccggaggatgtacctgccaagtttcacacgcgccaggtggccttgcagcttaccattacggtcaacgcgagtgtcgagttgacgagggttgacgtactgcctcttcacgaaggtatccctcggccactgcttgagacggccttccgccgtggagatggtgccagttccctaaaggaaattcaagagaaagtctcgtcagacgattattgcctgctattacttgatctgagaaatgcatggcccagctacatgcaagtcgagctgagcactgaggacggcgctctaatagaagagacgatattgccagggtacacgtcgcgggtcatggtattactcaagcgggtttacttggaagatccacatgcagcagtcccaaccttgaacccagcacggcagcgtcaatttgttgtaagcacgacaatatcaccagaaacggaaagagccaaccgagaggcgttctggtacagagaggagttgctcaaccggatcaaggggtcatggcgggcgacttctggtaccaataggcacggcgccatcgaattgcgcagcatacggctgagcccgcgtatgatcgacgcggtcaagattgaggacgttgacattgacatctcagttgcgtcgcaaaatcccggcgacgatgagagcaagaacgtcttgtatgttgacgaattctcgcgcctcaacgtgcacatcatcaaccggtccgcgaagcccatttacccgacgctgcggctcatgccggccctctgccaccgaccgctcaacgtggcgctggactacacgagaaagtttggttggatcgggacactgcagaagtcgctgccgctattagaggcgcacggggagacgaacgtcgtcatgaccgtggccgcgctctgcagaggtcagtttgaggtcacggcatcggtggaggagacgcaactctggcgggacgagggagcgacggccaagggcagcgatgaaggcggcagaccaagatcagatacgcagacgctgatggacgcggttttgggggccagagagaggaggatctggcacactcgaaagcccttcactgtgacagctctggatagagacggatgaaaggaaaaacgagcgacgatagctctgcattttagggtatatattgaaataatttatataacagcatttactgacaggggttggctattggaaacgagcaagaaaacaaaaggggaagaaccgactcagagtaaagtcgaggaatccttacgaataactgacgcgctagggactggagctaaaagtcaaaggaagaaaaagtcagcatgaggcgaaagattctttgcttcagggccgggataaacccaccgaatccgagggcctggctagactacacttggacctgaccgacttttccgaatttatttttcggtccgtctcctcactcgtggttacggagtacacattcctgttcaattcttagctcacatagttggacattgaacaaagttgcttgagctggtgttgagtcattttttatttcgacgtttccgagtttgtctctttcaaggacccgctttcctggtggcggaatcggccgaagcataccttacctagct

SEQ ID NO: 53 - DNA, 4216 bp, Magnaporthe grisae
tcactccggaacctgcataatcgctagctcggcttggcttgcatttcgcgcgtcagatggatcggactgtggctttcttgctaagagagacttgaataataattcaaaaatttaggattgcttgcggagcaaatgggagaaaaatatgctcgcatgagcaaagtctgaagggattccacaatcgaaacgaggactggagttgttggcagtatacagaacagactgccgcccatcacgagaggggaaaaaaaaagaccagtgacgataattgagattaaaagccgtcaacaaccgcaccctctttgttttatgatcaacactgaccactgttgatcccaattgccaaagaaagacaaaactcttcattcactttgcttagtatatcaatccaagcgatcacgggttcggcaaaaaaacaggcatttttaactatgcattgagtttgaaaaggcaacaggctccagaatactgtttcgctttgccttgatgccaagtccaatatggataacccatatcccgaagaagcgctgcttgacaaccaccagctcatacaccaagatgagcagcttggtcaaactgtttttacaagagaagactttgaatatgcgctgagagattttcaagagatgtctggaggagaggacgggggtgccgtctctgaggtatcagatgcagactcagtgtatctcggagtccaagagcagatcaaccgggcccaggcagacaggactgcgtttcttgacgccttccaaaatccccaagaagacgacgacgaagacatttatgatggccttccaacaaaacctcccccgcgtaaaaaggtcaagaggggacccgtggtgaggaaaggaccaccaatcaagaaagcgcctcgcaaggccaaagaattgcccaccgagatcaaggtgcttgtcgatgccgcgaccaatgccttcatagccaatcgatacgatgaggctctacaggccgcaagggaaactatccgcctcaatgcggaagtggctccagcctggggcatcctggctgccgtgtatgaggagagagaagactggcggcacgcgctcgaggcaaaacgtatccaggcctcactcaccaagggcgacacacagctttggcttggtactgcagacttggctttgcacatggtagatggcgcctatcaggattcacccgaggaaatcgacaagactttgaaagtagctatggactgctacaggagcgtattacagatcgacaagacaaaccccgttgctcgcctgggcaaagccgacatcctcgcggacttgggacagtccagcaaggccgttgctgcttatctcgactacctcaaacagaaaccttataatcttcgtgtcgttcgcagcctggccgagcacgcgtacaatgcaagacgggcaaaggaggcaatcgaagctactgtactggcatacgaagcttgcattcagcatttcaaatcggggcagaccctggatgacgatcaagtcctcgactggatcgacgtccgcattttcatagagctccttgcttccctggagaagtacgatgaagccgcaaaatggctcaagactctggtgaggtggctggtaggccgcaacgacgaccttctctgggaccagtgccaggatgaccgtgagtgggacttggatgatactcgaaggttggaaatggaaggtttcaatcaaggcgagttcctgccccaaagctatggccatggcctgcccctcgagctcaggggcaagcttgccgtctatcggtttaggacagacatggaagacgaagcaatgagacatctcaggcaactcgacccggaagatgcagacataagggggaagctacaattcacccctgagattgccaaagaggttgcagatcagctgtgcgaaagcgggaagcccgagcgcgccattctatactatgacctatatcgggacctggtaggcgaggcattggatgccgaatattacgtcaagcgagccaagtgccacgtgcaactggcagatgggccagcggccgaggattgcttcatctacgcgcttgaagtagacgaagataacatcgaggcacgttacgagctggcaaagatgtacgaggaggcacaggaacgagacgaagccttcaggctggtgggcgaagccctgagcctggaagctgggcagagtgtctacgatggtctcacgcaccgctacgtcgtggacaggggtaagattgtatccaagcccaaaaagtacagaacaggcgccaccaagcgagccccaaccaccaaggccaaatacagaccgcgaagacttatcggcggtggcagtggcgagtcggcacgcaagaagtttgaggatgaggtcacggcacgccttcgggaaaggtacaccgagtgtcaacggctcaaggcgcagatggacgcgaatgtggctgcaagtggcgggcatgacacaaatgacccagtggttgccgaatggatgtcggctgccaaggagttggtggacgacttcaggtctttcagggagttctactcatgggagcgatacgtctcctctctcggctacgggaatttcttcaaggccgaggcatctgcagacggaaatactggcgatgagaggtctaggtctattgccaaaatggcgaaaagactacacaacaccctcgcccccgtcgagaccgaaggcgaagaagccgtaccgcaaaagatcgagcgccaagagcatcgcggcatcccattcaacgactggcttgacctcttcctcgaatacgccatctcgctggcccggcagcaacggatcggcgaggcgtacgccgtgtgccaatcagcgcgagattcgatcgtctacggtaaggccaaggacagcctgatgctgatacacctggcctgggcgtcgtgcgccgtccaggccggcgacgaggagacgtgcgtcgctatcgcgcgatactttatgatccacaaccccttcgtcaccgacggctacaagatgtttgccgccctcacccgcgtctgccagacctcgcccacctggtaccagtccggcccgtcgcaaaagttcatgctccgccagattcgccagatggacgagatcctggccgccaaggccaaggaggaagaggacgggttcggcgcggcaagcaaccaaggctcgcaaccacctggcccctcggcagaaacgcagatggtccctgccacagccgccgccgcgcaaccgggccccacaggcgtcgacgcggtcctgctcgtcctgtacgggtgcatcctgttcgcgtcgacgagctaccagtacgcgttggcctactttctgcgcgcgcggaccgtcgacccggacaacccggccatcaaccttgtcataggcctggcctacatccactgggcgctcaagcggcaatcgcacaaccgccagtacacgctaatgcagggcttctcatacatcttcaaatactacgaggacagaacgcgcggggccgccgcgccagaggagcgccaggaggcgcactacaacgttgcgcgcacctaccatctgctgggcatccacgacctcgccctcgagtactatcacaaggttctggtcgaagccagagccgccaggacggaggtgctgcgaggcaaggacgtttccgttaggcgtcgggaggatctcagtctagagtctgccatgaacattcggacgtactgtctgagcacaggggatttggaaggtgccagagctgttactgatgaatggttggttttggagtagaccaaagggattgttagcatgcaacgtaggcagccccgcaaccacgattgctttcaagaaaccccaaacctaacgactgccaagtttctattataacactattatcttatgtctaatgctacatgattaggtatacagtagccaaagaccgagacctaataggatgatcacatattgagcaaataaatacaagtcaaaaacaccaggggcctagagcaaaaagaggaaagcaaaaaaatgagcgggtcaaggtgataatatgcacacactcgagaaataaaatgatatatcctaattcttctagatgtatattttcgtcgctttaacaactgccctcgatccagtcggcatcgctggggtcatcttctgtttcgtcactttcgctgcttttgtcccaaacgtccatcccgtaaatcccctcgtcaagtttgggtgcgacaccaagttcgggcgagtatctggttgtgcaaccaggcctgacggggctggaatatccggag

SEQ ID NO: 54 - DNA, 4374 bp, Magnaporthe grisae
tcgtatgcacactgccttggcacgggtgatttgaaagggtgtaccagaacagggaagggcgtcgacatggtggttgactctcggcgttaagttacacagttttgaccgattgcgactcagaaaagatgttatttcaagtatcaaggttgaagcctcgagaaacactcattatttgcaagctgtaacatttcagtccaagtgggcaggaccgtgtcaatctccagcggtaccaactgctgctgttaccctgtattaattacagcgtcatcaggcatggtgggtgtcgaaagcggggctccgaagccgccaagcgctggactttagcacaatcattcgccagacaaggcaaagttgcgtgtccaacccatcaacacgtaccgaatttgtgaagacttgactggcaaaaaaaagaagaaaaagaaaaaaagatacaacagcaagcgtctgctgcaacggctccccagaaaatgtattgagggctgtaagtctttggttttaccatggagcaaccgttgttccgcaactcgtcctcggcgcggactgagttgtttgccaaggtcggtaggcccatcatcagcaagcttgtgatgcggccgtccgcggcaccatcgcaagccaaccagttgctgcagttgacggatcgactctactccatccttaatggacaggtcagctatgacgcctcggctgtggatgcaaagattgcagaatatgttttcttcccgctgtcgttcgtcttcaagaataaggaggatcactctgcccgagtgctagaaaacgccatcaagtgtctgcggattttgattcagtatggctggcgatctaccatctctacgagtctgactcaacagctactcatacttctcacattcatcatcgccggcgttcctggccagcagaggacttcgccgccgccggaagagacggtccttgaatgctacaggtctcttgctgtcttgatcagagaggcatgtctgtcaagctccgtatcagaatccctggttgactccagtggtctaccaagtctaggccacaccgtaactgtcattttggatggcagcacggatggaatgactgcagatatccagcttgcggcactcgatgccctgaggactctctttgtctcgatgaaagaccgtgctgcacttgcatccttcctcccaggcagtgtgtcgactctgtccaaacttctctcgccacctgcgtcactcaagcttcagaaacgtgtgctctgttacggagcaagagtctttggggacgttctgaccagggtgctaggcgacatacacaatagagatgcgctgaggcagctcacctcagacacgaccggggagggaaaagacggcgagctgtctgggacagagctatctgcgtcttggctcaaagctacatccgctcaagtcaggatggcgctcgccatggtgctcaagttacgatcccacgagtcggataatgttcggaatgccgttgagaggcttgctctatccctcttagacgaatgtcatgcgtctttggctgactgcacagtatttctcgtcgagacggccatttttacctggaagaagaagatgattcaactgatctatcggggggtccaaagcataccgcttcaagcattcgtgactctgctctgccagaaagcgtagcggttcaaactaccttgcaggacctggccatgatatacccggaacttcaagatgctatcaagaccgtggtacataatatgattaccagcatgcccagaatcatgcaaacttcagacgaaaaaattaagcagcagtgcatatttgcactctctcgagggcagcgaatagtgaaagtcctgaatattgactcgtccctgttgcatgaagcactgtcctcggctctgagagacagcattgtggctttgacctcaagcaaaaaacaactgaacgtcgtggccgacgctgaatttgaaggggagatgagtgtcaaccccacagacttggttacacggccgggtgaaacgcgaacattcaagcccatcatgctggcgcatgggagtcaagcaggtacacgtgatgccttcctcaggttggtttccggtattggctcgccatctcagcaggcagatctggctaccgacatgatcagtctggcaagggatttgtcaggaatagatcaggtcacagccttatggctagcgtttgagttgctgaaagtagcactagccaagaacgagcaggacgagcagttctttgacttttccggcaccatgtcaacaaatgagcctaccgaagtcttccaagagctctatcagctctctgtcttgatgctgacatcacatactgacagtctcgaagtcgactggagactggaggccatagctattgaggttacgacttttgccgcctctcaaatgggggtttcattcaggccagagctcattgatactctctaccctatagcaacctacctgggctcacaaaatacccagctaaggcttcacgcgatgacagcgcttggcttgattgcgtcagcgtgtggatatcaggatgtgtccgagttgattgttgacaatgccgattacatggtcaactcggtatctctgcgcctgacttcgatggatgttacaccggcgtcactccaagtactgaggatgatggtgaggctgacggggccgaagctgttgcctttcctagacgacacagtagccgccatttttgctgctcttgataattatcatgggtaccccgccttcgtcgagcgattgttttctgtactctcagaggtggtgcagcagggtgtcaagtctgacgtgctcttgcttgaatcgaaggaatccaaaagtcttgaccacaggaaaagatcaatggcagcagcaaccatcaatgatattgaatcagaagtgaaagagaggattgcaaagaaacagaagaggagaaaggagaaagaggatcttcttccaggcgttagagccaaacatcctcagaagccgtggacttctgaagcaaaacagcttctagacgaaagggagaggaagatgaaagccgatgatgaggagaaagcagaagacacagggtcaggcggtgaggtcgagaaaccaaagccggtccgtacgccaacatatgaactgctgtcacgagttacgaccttgacgcaatattatttaacatcaccaactccgactttgcgaaaatcgttactggatcttctctctacaattactccatctatggccctggatgaggatgcatttctacccatggtcaactctctttggccggtcgtcatctcgcgccttcgcgacggggagccatttgttgtggctgcagcttgcagagccattgcggcgcttgcacaagggtctggggacttcctggcctcgaggatcaagactgagtggtgggactcgatgtccaggtggtgccaaaaggcaaagcagaatgccaagactggtgcgacaggaaatggtgggagaagtggaaagagcaacaattctgttcccattcactccggtcgaaatataggcagactcaacatggccttggttggcaatgaagttgtgctgccacaccgtccacagggcagtagtagacctggcagcggcggtgttgatactgaaaagtattcagacggcggactgggaaggtttgcgcaggcatcacaagtatgggaggccaccgtcgacatgctcgttgcactggtctcctttgtcaggctggatgacgaggtttttgaccaaatactggaactgctcgccgacgagctcgagagcaattcagttgctcgcaaagcactcgaggtggtcaatgcggatgcggtttggctggctagatttgaacgtggctcgctgacacaagatctcagtgtaccagtcatggacggaatcaggtttgctgctttggcataagcagcaggtcggtctggcgatggataagtacacacctagtcattggctacaaaatacctctcggggctactaccactcgaaatggattaatcgccttttccgcgccagcctgctacgtaaacctgcctccaatcaacgaactgctgactgtgccgccaaagcatcatgttgtgggttgatacgacgtcgcaaactcggaccatgcataagtaagcggggattgggaagtattctatgcgggttcgttgcacccgcatacttctagaacccttcgccgagtgagcgtgctttgcattggtgcttggatgggacgttgctggcagtagaaactttacgtagtaggtcaaagcggtatcctattgacaaggacaccggcggccgatttgggtgaaaaatccgtgcctctgaggtatttggagcagtatacgcctttgatctttgtttaaacaaagagtggctcactctgtaatcttatcgcgcatctcacaaagacgcatgtg

SEQ ID NO: 55 - DNA, 3496 bp, Magnaporthe grisae
gccgccctggattttgagtcactatcgctgcggcaggtgcttacatcccgcacgctgatgctgaaaacatgtccaaaccacgtactattagctagttctagttctatctagtagaaacaaattatttagcagcctcttgccgccataccgcggcgacaaagtcaatgtcgcaaaggctgttgtttgctgttaaatgcagcccaaggcccgcatgtcgttgtccctgcgccgtcgatctatttttttattttcctccatcgcgtccaatcaactcgtcactgacaacagtggccagtcaaaacaagagccagcgactcgatcaaattattctgtctactgccgttgcagacatcatccacggccccacccaaacccgcagccgcagcacttgttgcccctccactacgactagttttggtaaccgtaaagagctactatcactaccacgcaaacggaccaacacccctagttctgcgcgtcacttctcgtcaaagtcaagcatggccaccgatgcccaagggcctggctccctcgggaacaaggcagccgcctcagatggcatgccaaatatggtgatgccatatgaacctcaggaccccgctgtcatcgcagagatggtccgcgtgctcgatgagcatacaaagggtggcgccaagggtcgtttccgtatcaagaagaccaagtttgccgttactggttctccttccaaggtcactgtagattcctggaagctacaggactgggactacaagaaacctgggctgcctacatatgcccgtggcctcttcaccacgcgcctcccaaataatgtaccagaaattgccgtcagaggttatgacaagttcttcaacgtcggcgaggtgccggaaacgaactgggaaaatatcatcaagaacagcaagggtccttacgagctcagtctgaaggaaaacggctgcatcattttcatctcaggccttcacgatgacaccctgttggtatgctcaaagcattccactggtgcacgcggtgatattgaaatcagccacgccaacgccggtgaaaaggctctcgacaagcagctggccaagattggcaagactagggcggaccttgcgcgggagctgagggagcgcaatgccaccgctatcgccgaactttgcgacgacagctttgaggagcacatcttggcttatggccccgataaagccggcttgtatcttcacggcatcaacgtgaaccagccctacttcatgacatatccaggccccgcagtcaactcgtttgccgacgactggggcttcaaacagaccgggttgctcataatggacaacattaaagaggtcaaaacgttcttagaagacgtagcagaaactggagcctacggcggccgagacgtcgagggctttgttatccgctgcaagctgaaggaccggcctaataccgaccctggaacatactcggattggttcttcaagtacaagtttgaagagccttatcttatgtacaggcagtggcgagagtgtaccaaggctctcattgccggccacgcccccaagatcaggaaacacaagaaaatcacagaggagtacctgtactacgcaaagacacgcctggcagaggactccagcctcgcaaaggcctataaccaaaaccacggcatcattgcccttcgtgacgattttctgaaatacaagaacatgaagggttccgatgctgccaatctcgatcgggatgtcgccactaacgagccggagccagacaactcggtcgttggcaacgtgatcctcgttccgattgccaccattggatgtggaaagacaacaattgccgtcgccttgaggaccctcttccctgaagcgttcggccatttccaaaacgacagcataacacagaaaaagggaaggccggctatatttaccaggaatgtgctggaacaactaaagacaaagagggttgtcatcgcggaccgcaacaacgcatggcgtcgtgagaggacacaaatcctgggcgacgtcaagaatatgctgcccgcagcgaagctggtggcgcttcatttcgaccacgacaacagcatggaagtccgcaagctgacatacgagcgcgttttccagcgtggcgacaaccaccagaacatcaaggtgcaggagctcggcaaagcaaaggtcatggacatcatgaacggcttcctggatggattggagccatacagcgccttcagcaaacccgatgcagacttttctgctgccatcggtctaaaccctctcgccggcagtcggacgaatctggaggtagtgatttccaaattacaccagttttacccaaaccttctccctcgcgtccccacgggagaggagatggacaaagcgatcgatactgcactcgcatatgatcccaagttagagcagctggcagttctgcccgcagctgctaacaacaacaagggtggtattgagtacatgtcaattgatatcccgtcgcaggccgtcctggccgccctcgaggatgccttcaaggatgcctcccccgaggtaggccgcatgtatggatacctgaagcagcagcgccggatccagccggctttccatgtaacgctgatgcataaatccggagcaaagaccagcccagagaaccaagagctttggacaaggtatactcagaccttgaaggtggctcacgatgatgccaagtcaaagggcatcgtattcagggctgcggaaacccccagcctgggtgaatgcgacgtccaacttgagcgcgtggtctttgacgacaggctcatggcgattgtggtgcgcataatcgacaaagacgacaagtggaagtgtataaacagggttccgcacatcacgatcggtactctggacaacacggtgcctcccaaggagagcaacgatatgctggctctttggatcgacggacagcaggaggctcgccgcggtacaatccgcgagactggcattgagggccgtccaatcgtcaagggcatagtcaaggcggtcctgtcaaaattctgatagccccagtacggcaagaggactcgtcatggaccaaaggatgacggccaaggatttgtgtggttttcgttttgcgctgacacattacctcgatttcgtaggtggcgttctataggggcaatagcgcttgagtctagacgtgattcaaccggtcattcgagttatggattcagctgcccagcatgtattggttagcagcatcccgcgggtgaaataaaagcgcatgtttttttttcggtatctggtcatgggcgcgaaaacaaatagtcttctttctaccttggaagaccatttagatacacagcagatatctgatcatcacactttttattccactcattacagtgccttttttgtcccccttaaaagaggttccatgggtatatcacatttaaaatggccaaggaaattctactgctttgcgggtagggaatccagtttcaacggcttatgctgttagtcaccttgacaaatgcctgccactgcctccaggcctcacc

SEQ ID NO: 56 - DNA, 3691 bp, Magnaporthe grisae
ttcaatgcctggtgatggcatcggccgtagggtaacttactatgtgcgaattgttgggtagcgtgctcattgcccggcgcacgagagtgtgccctgcaagccgcgtcggcattgatattctcgtggcaaggagcatcgtggcaatttgatagatcatcaacgttgaagcacgttctcctgatcgttgtagttgatgccgtcatctcgaagtattttccattgttatccctgtcggcacttagcagctagatccctgcttcaaagtgatcgaggtggggcatgctccactaagatctcaattaacgcgacttagattcacagtcgcgtctcataccgcgtcccactctaaactcttcctgtattggcagcattttcctccagacggctctgatcaacctcggtttcaaagtcaaattgtcgcaggaagctagggtacttgcggctgcgaaaatttacggaattgaaagacagtaacgtagtatccgcgataattttacgtcatgggtgaagcacagagtcctccccggctcagcccaagaaagaagcgggcgcagaagcccctcggcaatggcttcttcggcggtatcaaagaaacaccaggcagggcagcaccccccctctctagtgcagcaccatcctcgtcgccggcctttgcgacgcccgctcacacactgcggcccttcaacccgcaaaagcccgccggagcagccatcctcccgatcctcttaccgccagcaacactccgcccattggccttccggacctttaccaaaaaacacagcctgaccctcacatcgtctgctctacaagagctggcgtcctttgtcggccgacactgcggctcaggatggcgtgaggaagggctcgccgagcgtgtgctagaggaggtggcaaaatcgtggaaggctggcaatggcggggtgatagtcgatggggccagccccatcctgaaggacatcctcaagacgctggaaggcaacatggttgggggcaagattgttactggtgcaggaaagggcttggttcggcagaatagtcttctgttggatccctcgagggaaccggactattcttctaccacccgcctgggcctgagaccatctattgcacttcaacgtgatgacagccagtctagtatgggcatgtctgggctcaacttcgaggaagagcccgaagaagacacgctcagtgatccaagaaagtggttgaaagtagttggggcatatgaacagccacggatggtttataacgtggccaaaaagcacttcgagagagatgcttctaaaccttcgatattaccaacagcttctcataagacccttttgtttcgcaatcgattcaacgtcatccaccagcgtctccttcgtaatgaagcctttcagacatccgccgtcgccgacaccaaacgcggctcacttgcccgttcaacgtcatccctctcatcacaacagtcatataaaatcacacccattgccaacttacttggacgccacggcagccaccacatgcttttaggaatgctggtaataatgccggcaggtaaccttgctgtcagtgaccttaccggaactattgcgctagacgtcacccaagcagccaccattcccgacgattcttcatggtttaccccggggatggttgtgctcatcgatggtgtttatgaggaggaggatgaccacaccgccaagggcctcagtggcagcagcggaattggtggcaccattggcggtcgatttcagggcttcttcatcggccagccgccatgtgagaagaggcgagcgacactgggtgtcagcggaccagaaggcgatggtttggagcacaccatagggggtggctttggatggattgactttctaggagttgggagcgagcgcgcgatgggcccgaggatgcgaaagctggaaagacgtttactgcgccaaccacagctttctcgacaagacatggccgcgtcggtactggagtccactctttcatcaacgctccccagacgtggccgaattatcatcttgggcgagctgaatctggaccagcctcgtgctctgcaggcattgcgcaagattctggccacatatgccaacgaaacagacaatgatggcagcgaaaacgacgccgctgacgagactgttgcaagcacgaaacccaacaagaccacgacacctttggcctttgttcttgcgggaagcttttcatcacaggccgtaatggctcggaacggagctggtggaggtggaggaggcggatccgctggattaaccggtagcggcggagggggcagcatcgagtacaaagaatactttgattcactcgcggggactctagccgaattcccatcgctcctacgagaatctactttcgtctttgttccgggcgataacgatggctgggcttcgtcatttggcgcaggtgccgcggtgcctctaccgcgcaaggccgttccagaccttttcacgtcgcgcgtccgtcgcgccttcgccaccgctaacgccgaagggacctcgccacgagcgaacgcgcctgggggcgaggccgtcttcaccaccaacccgagtcgcatgacgctttttggtccaaatcacgagatagtcctgttccgcgatgatatatcagcgcgcctaaggcgggctgctgtgcggctcaaaggctcgtcctctacctccaccggcccagagcacgacaacaacgaagtgcgcatgtcggacgacgccccgacagcaggggacatggaaattgacgaactgcctgatccggctgtagagagcgcagcttcaaaagagccaagaccagacatggtgccgcatgatgtgcgcgcagctcaaaagctcgtcaagacgatccttgaccaaggatatctggctccatttcgcacagctgtccgccctgtacactgggatcacgcctcggcgctacacctatatcccctaccaactgcactagtgctggccgacgctacggcgccgcccttttgtgtgacgtacgaggggtgccatgtcatgaatcctgggccgctactcgtaccagggaggaggggagttgcaagatgggttgagtataacgttgggcatagaggaagcgtgaaagagtatggcgaagctgccatgaaaaaggggcaggatccgttgactaatgacacgaacattattgaggcgcctgtcatctgtcaaattagccacctcggtccagagtagggatctggttctaccattcgagctcgggtaaatctctcgagtttcaaacagtaaaaaaaaagcaacgtaaagatattgatacatctagatagcgtcatattacactggtatcagcccatcgttcatcggcaactgatcaatccaccgtgggggtctgagatgtccccaatttttgctagcccaaaaaaagaaaaaaaaaacgccttaacaatctgtagtatacataagaaacggagagagggtcaactccttcatttctccgacggcttttcagcatctcctgtattcgtctgcgcgtttgcgtcgggctcgttcttgttcccgccaaaccacccaggcgctgaggcccagctcagaccagaagacgacttggcatcctgtgcagcagccgcaccaccctctgcggccttgtcctcgacggccctgccctcgcgcttggcggcggcggcggcggcgcgctgcctcctcttgtccatgatctcctttgcgagtttgtcctc

SEQ ID NO: 57 - DNA, 3358 bp, Magnaporthe grisae
ttccaattgatctcgaccatggatatctcatgcatgagtctcgataaagtttgtatatcatcagcaatgattgtgaggcaaacgagtgatgaaatgagttggcaggctgtagaacatgcgaaactaggcataaaaatctctagcatacaagaactgttgcagtcgatggttagaatatactcggttgttttactgggtcgcggtagtagcgaagtttaaacagcaccaagaagcaagtggatcccgttttgatgcacggctgactaatctaatgatgcaacgtcaacatgccccgctcctccccagcttgtctttgcagctgcagttcaaaaaaaagttgctgataagataacacgagaaaagtctcgagctccctcttctatccgccaaagtcctgcctactgccccaactgcctacccaacttgcttcgcgcagtgccgacaacccctattattcaccagcttcttgaatagagccgcggctcatcctgattgaagcaatgggtaaacgaaagagcgaacagcaccgaggccaccatgggcgcaagaggaggagattggcggccgaacgcgagaatgaggcggccgaggaagccaagcacaacatcgaggagcaacccgccgaattgaacataatccatgacgacttcatacctctcgatgaagacaccggtgcagcaggccctccagagacgcgcgagtattttggaatgctcaccgaagacgagcaggaggagttcaagcgactagacaatgccctcgaggacgacgacccgaacgtggaccgtgaggagctcctcgccacgatatttgaagtggccaagggcaaggaactcaagctcgcctgtagtcagtcgtgctcgaggttgatggagcggttgattctgctgtcaaacacaaggcagaagaagggccttttcgatgcctttgcgaaccatttcccgacgctcgtcactcacagattcggcagtcattgctgtgagcagctgttcttgcagtctgctccggtaatcacccgagagctgactggagaggttgagggcaacgataaggatgcacaggaggagggcgccggggacggtgcagagaagcagcccttgttgaccatggaggagctgttcttgttagtcttggatgagcttgaggagcatttgaccgtcctgatgaccgacaccttcggctcccacacactccgagtgctactcaccgtcctttccggtaggccgctgagtcaagtggcgaccaaaagcctacttcagagcaagagaaaggagcagatcgctttaccagacgggtggacagcaacggaggaaactggcgaccaaccgagagctgttccggcatgcttcgatatggcagttcgcaagattatatccgatgttttagttgcactagacccgaccatgctcgccgtcatggtcaagcaccctactggcaatccaatcctgcaactgctgctcgagcttgacattgcgctcaatacaaaagccaacagcaaacgcaagtcaaaagctcaggaagcggaggaggcaaagttggaggcagctgaagaaaagcccaaggaggaagcgggtgcgccacaaaccttgcttgagcgcctacttcccggtgcaccgtccaccttgagcgaagagacctcggaagcggcaaggtttgtcagtggcacgatctacgactcgataggatcacgcctgctcgaaacactcgtaagccattgcccaggcaagatattcaaaggcctgtggagtcacatcattgggcctcggtttgagacactcctccgtaacgagacggcaacatatgtagcaatgaaggcattggtcaggctgagtcgagaggacttggcggacgccgtgcttaagacgataccgaaagtggaaatgctagtgtcgaaaggccgcttcaatatcttgacgctgctgtttgagcgctgtcatgcccgtgaagcctctgtatcagcagatgctctgctaaaggctgtaacagaggcgtgcagcgcattgggtggatcacttgtccgcacgctgtgttatcttgacgacgaggacaccaacaaggaagaaaagaaagacaaggtcaaaaaagctgaaaaggaccaaggcgacaagaaagacaagaaggataagaaggacaagaaggataaaaaggagaagaaggacagaaaagacaaaccggccgtttctcaagagaaggaacctcttgcagatccaccaaagaagaaggatgatctcatccgcaatggcaccaagttggcaacaaccatgatacaaattggtgggaaaccggcacaggccgtacagggctctctcctcttccttgaccaagaaaagctgctgcacctagcgacatcgtcaaccgcgacagccaaattcttgacagcagccttgtccgctccgtcttcgaaccccatctaccacaagatgctggtaacggcactcaagccgcacgccatggagctcgcgcattcgttcaccggatcattcgtgatcaacgccgtcgcgctgattccctccaaggcagagggattcgcgcttcccttctttatcaagcaaagcatcgtcgagttgctgaccgctgacgatgcgagcctacgcagcactccccagggcaggaaggtctgggctgcgtggaagggcgagctgtgggttcgcaagcgggcagagtggatacggtgggcgarggaggtcgagcccgaggaggcccggtgggcaaagacgccacagccgagagtcaaggaagagcgtccgggtcagaaaggggataagaaggatgggagaggcccgaatggccgtcagtttacagacaaagatggcaaggacaaggacaagaagagaaaaaagcaggaggcagatgagtgaatgtcagcctagagccgtaacagattattggcttctgtagataccccagagtcgacgaataaatgtaactcggtacccattccaggagttgaaaattttgacaaattctgatcatactgtcacatcacgatgatggttttatggaatacattatcaggggtatcgccgtaccatgaacgccggtctataaaatcagatctatgtctcctccccattgaaacacccatatatctaaatcccaaaagccaatcacagtccatcaagatgaagtaagaggaaggctgccttggtcccaccgccgttctaagtgatctggccgaatggtaagtcatctataccatgcgctgacgctagtctatgatggggaccaccagatgaggacgtacaatttgctgttcttgcatgaccgtctatgattgtgttcatgagtagtagccatggctggactgtctcgactctgagctctagagtgttttatgccatttcccgtcagcaaaccc

SEQ ID NO: 58 - DNA, 4048 bp, Magnaporthe grisae
gtgtgggggcgatcaagtttactaatgcttgtcaacagggatgtcactcacccctgtcccagaggtgcacgtcccccggcaacccgacacggtttgtgtgtggattacttgggcgtttgtgtttatgatcggtcgggcagactccaacctcaaagttgcgatctcgacgagaagaaaaaccctggccactttcggacattttctgtccctgccaaaacgaactgaaccgccatcaacccaaatgctctacaatcgcctcctgcgccacctttacgagaaacaatcgctgaagacttttgctgcctggtaagatttctcctcatcttaggtttgcaccatgtccaagtgccttgtctgccgcggcaataatccctggccacgctcggccgcatgagcaaaaacgagctgacccatattctaactgttgctcttttatccagacgcctaccctcagctagcaccaataagcagctcgactatctcagcgcaaactaggagatatggccgaaaaacttgatgaggaccaggtttccggtctcatcgccatactccgcaaggacgtctcggtcgacgccaaagttcagcaagtaaatgcggtcaagtccagcatcaagcagcacaatgtgcctgataactgcgtcgtaccggtattcgaggccttgcgcatcgcatctaccgcccagcatgccgtcctggtcaacgccggcttcactggcctcaaccaccttataacacgaatgtcgcgacaagatccgaagtaccttagcaaagaggctgtccgtctactgccgctgctcacagagaagcttggagaccagaaggaaaagttcaggacagttgctacgcagtcactcatcaccatgtacaaagccacacccgcagaagtcgagcgagtgatccgcaacgtagccatggtgggtaagaaccccagagctaaggaagcaagtctacactggcttcttcagatgcaccaagaacatgggctccagtttcgcgcctatgtgcctacccttatggatttacttgaagacgccgacgctgctgttcgagacgcagcaaaaaccaccgttatagagctgtttcgaaatgcgccaaacgccgccaaatcagatttgaaaaagcagcttaagaatttcaaggtgcgccctgcgatcgagcaggccatcgtcaaagaactcgttcccgcatcgctctcggcggcaccctcggattccgacgctcgaccagcttcccgagccgaatccacgcgatcaacacgcgcaaatctttcggcaagcacgacatcggctggcatcgaacgtccggttacccctggtcttctcgacagcaaaccggaaaccgtcgatcccacctatgtcaatacccaaagagaactagatgatatcgtcaaggagatgcacctctatttcgagggcaaggagacggagcagaattggctgcagcgtgaagaaagcattaagaagctcaggcgactgttggcgggtaacgccgtctcagacttccatgacgcgttcctcggcggtgtgcgcggacttttggacggcataatcaaagccgtcacttcactgagaactagtctttctaaggagggctgcagtcttgtccaagagctggctcttgcgtacggtccgggcatagaccctatggtggagattcttatgcagactttcatcaagctttgcgctgcgaccaaaaagatcagctctcagttggccaatgtcaccgtggacaccatcatcgcaaaggtcacttacaaccaccggattatgcaacacgtgtggtttgcttgccaggataagaacgtgcaaccacgaacttatgccaccggatggttgaaaacactgctcaacaaagaggctcagcagaagtcacacatcgaacaccacggagggctagatttagttgaaaaatgcatcaagaaggggctcgccgactccaatccattggtgagggagaaaatgagggtcacttactggactttcaacgaaatatggcccgcaagagcggaagcgattatggaagatctggatgccacggctaagaagctcctgcaaaagagctccggaaacacgagctcgcccaagccggccgctggtggtgcccggcctggcatgggtctttctaggagtaccatgaccgcttccaaaccttctttaagagacgccatgttggcacaaaaacgggctttagcttcaaagaatctcccagcaaggcctggatccgccatggcacatttttcacctgtggggactgcatcttcagcctcatctgcagcggttacttccactactaccgccaaaccccctgtccgccaaaagcagctgcaggaggcccccacttccactggatcaaatagcctttcggtcgctccaatgcgacccggtagaaagagactcgagctggcagcaagacctgctacagctggcccctactctgtgaggacacatgatacagtatcattggagcagaacagcccaccagagaaaacaaggccaaagtctgctgccagtaaggcggctgctccttcgcctcgcgcgagtccggcaaaaccaaagcctactgcaatcgctcgcactcttcgtgagagcagcccgtccaagccagttgatgcgcccagtccggctagaaccatggcctcaccgatgcctgggtctcccgtgtccgcgcctcctccagttctgaccgaacctacccaggagccagaaacggaacagcaagagactaggccagaatcaaggacgagcacgtctcctcatacaccgccacggccggtcaaggtttatgaagatccattcacggcggacgaaccttcgactaagccgaatttaacaagacctgttctcgaggatatcccgattaatgaggacgccgcaaaccttgttcgacctgtcgaaaccgaccctgttgtcgccagcaccgacggtggcccgccagacaaagccaaacacgatatccccatcgagaaggtaccggatgttaaggcacagattcttgctactatcaagctccttctcaagagggcccgcgacaactttcaaccacacgtatctcacgccctcgaatcgctcctcgaggcaagaggggtatacgaagctcgtacacatatagtctcaggcatggagctactggcagacgaactggtgactataggtgacccttcggaaatggtcgtagttctgacacaggccctgcagggtgtcgagatggacgcaaggggttgtcggtcgctcaacatgggcttgcacgttctgagggaagttgtcgatgcgcgtccggattttcatccgaccgaatctgaacttgccgccctgagcgggttggccgcgcgctgccttgaaagccatgagtctggcgtgcggatggatgcagtccaattgtgtgttgccctgcatgcccgtgtgggcgatacacgcttctgggacaacatcaagggtgtcaaggaggaccctaagagcctcattacctactacatcgtgaaaaggcagcgcgaacatgatgccgcagccagtaatggattgtcagcagctgccactgcgactgtcatttgatttgcatggggcgacacacatacccagaactcgcctttttctttcgacactttatggcggcgccatatactattttaatttctctcgtctttcctagctcgtctttttctttctttttttttgtgcacctggtacggagtacaatacaacgtcggctggtaaaatatgccaggcgataccggactgggggtaaaattaggactgcaaagtgtttgtttggcgtttcgaatttcattttgggtggtgaactggctgtatgggcgggcatcaagacgacttcccgccaacttgactcctttaacttgaaatcttgttccattatcaagtacatgtcaaagtaggcttgctgggtatacattgtaactacaaaatagggcgattgtaagcttggtacttaaaatataggaagacttcactaaggcatgaataagctatacgttttcgttaccgacgttgcttctgtggtcttcacataggccaactgttgacctgatgtagtt

SEQ ID NO: 59 - DNA, 2893 bp, Magnaporthe grisae
cctgggtacctgggtgccttacgaagaataaactcgtcgcaaagtttgagcgatgtgacaagagacgaagcttgcggtcttgaggtggttcggcccatggtatattggtcaaaagttttccttggcaactatttcagatgatgagagcagagcaaagtagctattatcaatggctacatcatgtacggtggtacttcgtagtatcctggaagctgtctattttcccggttggcggcaagcgagtgcacgtgcaatcgccccagtactttacgctgttaccgtatggtcagtgctgagtacggggaattgagttccccacatgtcccgggtcccccaagtgccttcttaccccttactctattgttagagttaccgactccatcgtcattatcaccttacgcatcaccacatcgtggctcctcgacttagatgcatacgagctacaatcatctggggtctagcactacataccgcattttaaccaagctagcgttgtcgccatggctgtaggcttggctaatggacgacatgccgccgaggaggaggcgcgcgccgaagtggatgtcctcaattcccgcctggaaaagacaacccagctcaccaagaagatcgaagcatgcctcgtgaggcttgaatcgaccggcaagagtgtccgtgaggtggctggacctctcaatggggagaccaaaaagttgcaggttcttgacattgataacgttctttccgcaatcgagagattacgagcgccagccgacagcaaaaacgacgaagagcaaattattcggatgggccccgagaaggcggacctgcccaactacctaaactctttgaaacgcttgaacaaagccctggtcgatatgaaggcatcaaaccttcgatcgaatcaacagacaatgaatgatctgcaacgcctcgtcactctgggaactactcaattggcaacccttttcgacaaactgttgcgcagcgaaacaccacgctcgctcgagcctctgcattacataacaaaggacaagccatttccactcctatcgcgagacaatgtcaaccgtttagggcccatatactcctttgtagcaggatcaaataggcaagggaaaggcgttgggtccgaatccacgattgccgaggtgtactcggaggttcgtggcccatatttggccgagactctggccaacttggctgccgcaagtgtcaacacggccaagaagaagaatcccgatgcagtttaccgtgccggaaccaatggcattggtacctacgcccaggccatggagcgtctgttccaggctgaatatgagaatatcacgaggatattctcccgggaagattgggcccctcttttccaagccacttgccagaacgcgattgtggagctttctcgcacccttcgtgagatcaacgctcacatcaaagttcatctgaatacggattgcttccttgcttacgaaattgttgaaatcatctctggcatgtcaagccgccttgaggatttgcgcgcagccttcgccgcctgtctcaagccagtcagggaaacggcgaaaacatcacttggcgagctcatagaggacaccaagagaaaggttgccaacatgcagtccattccagccgatggtgcaccctctcctgttattgcagagactatgcagcgactgcaaaccatggtagaatttttgaggcccgtctccagcataatgatatcaattggcaacggtgggtggaagtcgttggcctcatcacgtggcggtggcgatgccttaccaagcctggcctcctttgacgttggagcgaatggccaggagatctttgcggattactgcagtgatactatcgacattcttttgctctcgctggatggcaaagcacggatgatgaatggaaagaagccggttgtcggtgtcttcatagcaaacagtattgccatcaccgagcggtcgattcgcgagtctgatctggcgcctttgatggagacacgcctgggaatattggaaacataccgaaagaaggcgaagctttattacacagagccttgcaaggatgtgtctatgcatcttttcgatgtcatccatacaagcaagtcagctcgcccatcgtcaggccaggcttctgcagactcagcaaccatcctgaagcagcttagttccaaggacaaggaaagtatcaagaacaagttcacgtctttcaacgccgcctttgacgacatggtagcacgccacaaatctttcagcatggagcgtgaggtgcgtcaaatgtttgcccgcgacatgcagcaaatgctagagccgctttacgtccgcttctgggaccgatatcacgaagtcgacaagggcaagggcaagtatgtcaaatatgacaaggctgccattgctgccgttttcgccagcctttactgagctgtatgcctcacgcaacctatacattctccatcttccccacaccaccacaaccacaccaagccgtccctaagctgcattcgtccagctatcaacatgcctgtctccaagagcggactttgcaggtcagcatacttgttctagtaatgtcgaatttgggaaatccatgcatatcgcatggttgggatgataccaaaacggtcagcaggagtttttggcgttgatcaagttagctttttatcgatcttcagttttctttccgctgcatgaatcatcaaagtctatgtgaccatcaagacggtaacgtatgctgaaccaggtcagcgctgattttattaatattgccctgagcaagtttaacaaggacagtagctgcacatcatcatatacgggtggcctcgcagggactctttcttggcttgatacgggtgcttttgaagtaagtaactaccacaacccagtgccaagtgcaaagattactagtgaaatacttggaccaa

SEQ ID NO: 60 - DNA, 2344 bp, Magnaporthe grisae
gctcaccgttgatattggcaagggtctggaccattagctaatgatgtggtgtccaatcacacgagacgtctgcagagatgatagcttgtcgcccctgcgcgcttgtccgaccagcagccgggtgattggtccgttgcagctagcacagaccaagcatcccatgtaaacaagggtctacgcgtgggaaggtacagttacgcttcttggatggggcctgctggggacggttcggttggctcgttggctctgtctgctctggggggcaggcggcggtgaacaatttcccacagctgaaaatcaacaaatccaatcaatcccgaccccatttttcgtgtcccctttatcctccctctccactaaaagaaaacccaccactgctaggaagcaacctctccttcacaaacacacaccacctttgcaagcatctctcaacttactctcgtactctctcgaccgcctcgctcccatcaacatcagaatccgacttgcaaaccataaaaatgcgtgaaattgttcaccttcagaccggccaatgcggcaaccaaattggtgctgctttctggcaaactatctctagcgagcacgggctcgacagcaatggagtttacaacggcacctccgagctccagctggagcgtatgagcgtctacttcaacgaggcctccggcaacaagcatgttccccgtgctgtcctcgtcgatctcgagcccggcaccatggacgccgtccgtgccggtccttttggccagctcttccgccccgacaacttcgtcttcggtcagtctggtgctggaaacaactgggccaagggtcactacactgagggtgccgagcttgtcgaccaggtccttgacgtcgtccgtcgtgaggctgagggctgtgactgcctccagggtttccagatcacccactccctgggtggtggtaccggtgccggtatgggtactctgctgatctccaagatccgcgaggagttccccgaccgtatgatggccaccttctcggtcgttccctcgcccaaggtttccgacaccgtcgttgagccctacaacgctaccctctcggtccaccagctggtcgagaactctgacgagaccttctgcattgacaacgaggctctgtacgacatctgcatgcgcaccctgaagctgtcgaacccctcatacggtgacctgaactacctggtttcggccgtcatgtctggcgtcaccacctgcttgcgtttccccggccagctcaactctgatctccgcaagcttgccgtcaacatggttcccttccctcgtctgcacttcttcatggttggcttcgctcctttgaccagccgtggtgcccactctttccgcgctgtcaccgttcccgagttgacccagcagatgttcgaccccaagaacatgatggctgcttctgacttcaggaatggtcgttacctgacctgctctgccatcttccgtggaaaggtttccatgaaggaggtcgaggaccagatgcgcaacgtccagaacaagaactcgtcgtacttcgtcgagtggatccccaacaacatccagaccgctctctgctctatcccgccccgcggcctcaagatgtcgtcgactttcatcggaaactcgaccgccatccaggagctgttcaagcgtgtcggtgagcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtaggatcaaaacactcttaccccggatgcttcccaattggtcgcttacgatcaaaagtcggcacctttgtctccttgctccaggataacatcgctcgcggactcgctgtctgtgctcgagctggagggctgacgtagaggctgttgttttgattgtgctgacatgttggagactgttgtcgtaatttgatacctctcccagagacaatggagcaaaaagatacaatgttcattggacttgaatgcccttgcctttagctgatgcggcgagccgtttttacaacctatgttttaattacaaagatgaatcagatattccattcactaagggcacatgtcaagcattgttaacaacacgcgcctgccggatccatcattcatggtcattcctatgttgacctgtggatgaccacatagattccaagtgttgagtaagcaacttgtcggttgcttagccttgtgcgtacaagtggtaacatcaaggtagagaatcatctgcaaggg

SEQ ID NO: 61 - DNA, 20 bp, Artificial
  Synthetic Oligonucleotide
atgaaggacgagacatcacg

SEQ ID NO: 62 - DNA, 21 bp, Artificial
  Synthetic Oligonucleotide
ttacatgccctcgaattctcc

SEQ ID NO: 63 - DNA, 25 bp, Artificial
  Synthetic Oligonucleotide
atgggtatcgatcttaagaagcacc

SEQ ID NO: 64 - DNA, 20 bp, Artificial
  Synthetic Oligonucleotide
ttagaccttgaaaccacgcg

SEQ ID NO: 65 - DNA, 24 bp, Artificial
  Synthetic Oligonucleotide
atgcactcgccgccgcggaagttg

SEQ ID NO: 66 - DNA, 20 bp, Artificial
  Synthetic Oligonucleotide
tcaatcgtcgtcctccaccc

SEQ ID NO: 67 - DNA, 19 bp, Artificial
  Synthetic Oligonucleotide
atggcacctggtagcagtg

SEQ ID NO: 68 - DNA, 21 bp, Artificial
  Sythetic Oligonucleotide
tcagccatcaccgttgggtag

SEQ ID NO: 69 - DNA, 18 bp, Artificial
  Synthetic Oligonucleotide
atggcgacgtcagacatc

SEQ ID NO: 70 - DNA, 18 bp, Artificial
  Sythetic Oligonucleotide
tcaagtctgctgcatgac

SEQ ID NO: 71 - DNA, 18 bp, Artificial
  Synthetic Oligonucleotide
atggcgacgtcagacatc

SEQ ID NO: 72 - DNA, 18 bp, Artificial
  Synthetic Oligonucleotide
tcaagtctgctgcatgac

SEQ ID NO: 73 - DNA, 28 bp, Artificial
  Synthetic Oligonucleotide
taaaatggccaccgatgcccaagggcct

SEQ ID NO: 74 - DNA, 25 bp, Artificial
  Synthetic Oligonucleotide
ccctcagaattttgacaggaccgcc

SEQ ID NO: 75 - DNA, 28 bp, Artificial
  Synthetic Oligonucleotide
taaaatggccaccgatgcccaagggcct

SEQ ID NO: 76 - DNA, 25 bp, Artificial
  Synthetic Oligonucleotide
ccctcagaattttgacaggaccgcc

SEQ ID NO: 77 - DNA, 24 bp, Artificial
  Synthetic Oligonucleotide
atgggtaaacgaaagagcgaacag

SEQ ID NO: 78 - DNA, 26 bp, Artificial
  Synthetic Oligonucleotide
tcactcatctgcctcctgcttttttc

SEQ ID NO: 79 - DNA, 24 bp, Artificial
  Synthetic Oligonucleotide
atggacaccctggtagcccgctac

SEQ ID NO: 80 - DNA, 19 bp, Artificial
  Synthetic Oligonucleotide
atgtgctactggcggaacc

SEQ ID NO: 81 - DNA, 19 bp, Artificial
  Synthetic Oligonucleotide
ccctcatcttggctccgca

SEQ ID NO: 82 - DNA, 21 bp, Artificial
  Synthetic Oligonucleotide
ctagtccagcgcactcgtaac

SEQ ID NO: 83 - DNA, 23 bp, Artificial
  Synthetic Oligonucleotide
gttcttttggggatcacgggcaa

SEQ ID NO: 84 - DNA, 18 bp, Artificial
  Synthetic Oligonucleotide
tggtgtctccaggctcgc

SEQ ID NO: 85 - DNA, 18 bp, Artificial
  Synthetic Oligonucleotide
tccagtttgcggagtaca

SEQ ID NO: 86 - DNA, 18 bp, Artificial
  Synthetic Oligonucleotide
tgagcatatccatgcgca

SEQ ID NO: 87 - DNA, 18 bp, Artificial
  Synthetic Oligonucleotide
gtactactgcctctccat

SEQ ID NO: 88 - DNA, 22 bp, Artificial
  Synthetic Oligonucleotide
tcaagcactcttgacaatcttg

SEQ ID NO: 89 - DNA, 21 bp, Artificial
  Synthetic Oligonucleotide
tttatggcgaccaacggcgat

SEQ ID NO: 90 - DNA, 22 bp, Artificial
  Synthetic Oligonucleotide
tcctcatgtgctcctcccactc

SEQ ID NO: 91 - DNA, 18 bp, Artificial
  Synthetic Oligonucleotide
tcgaactgctggatccca

SEQ ID NO: 92 - DNA, 21 bp, Artificial
  Synthetic Oligonucleotide
ccgttattcctttttgtctcc

SEQ ID NO: 93 - DNA, 19 bp, Artificial
  Synthetic Oligonucleotide
atgcctcctccaccgcatc

SEQ ID NO: 94 - DNA, 22 bp, Artificial
  Synthetic Oligonucleotide
ctctatcgtgccgacatttgtg

SEQ ID NO: 95 - DNA, 32 bp, Artificial
  Synthetic Oligonucleotide
cttgttttgaaaaaattcatcgagctcgccgc

SEQ ID NO: 96 - DNA, 21 bp, Artificial
  Synthetic Oligonucleotide
ctagttcccggcattctcacg

SEQ ID NO: 97 - DNA, 296 bp, Magnaporthe grisae
tggtagcccgctacagccgcccggcttaccagcagaacgagacattcacagaagatgatcagcaagacctttgcgattccgtcccaagtctttcactcaagtttgcggttccgccagtagcacatccctcatcttggctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaag

SEQ ID NO: 98 - DNA, 835 bp, Magnaporthe grisae
atggacaccctggtagcccgctacagccgcccggcttaccagcagaacgagacattcacagaagatgatcagcaagacctttgcgattccgtcccaagtctttcactcaagtttgcggttccgccagtagcacatccctcatcttggctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatgggtaccatgtgcgccggcgtcaccaaggaggagggtcccgccctgtactacatcgacagcgacggcaccaggcttgccggcaatctgttctgtgtgggatccggtcagacctttgcctatggtgtgctggatgccgagtacaagtacgacctgtcggatgaggatgcgctcgagctcggccgcaggagcattctcgccgccacccacagggatgcctactccggtggttttatcaacttgtaccacgtcaaggaggacggttgggtcaagcacggattcaacgacacgaaccctatcttctggaagactaagctggagaagggcgagtttaccaacg

SEQ ID NO: 99 - DNA, 288 bp, Magnaporthe grisae
cgacctgctcgtctcacatacacagttccccgagaatgctgcaaacaaccaagttgcgcggtatctctactaccttggtcggattcgcgccatacagctgcgctacacggaggcacacgagcacctgacggctgcgacgcggaaggcaccgagctctaactgcgcggttggtttctcgcagacggccaccaagcttttgctggtggttgagcttcttatgggcgatattcctgatcgcgcgaccttccgccaaccgaccctcgaggaggcactgcacccttacttcct

SEQ ID NO: 100 - DNA, 200 bp, Magnaporthe grisae
accaggccgacctgctcgtctcacatacacagttccccgagaatgctgcaaacaaccaagttgcgcggtatctctactaccttggtcggattcgcgccatacagctgcgctacacggaggcacacgagcacctgacggctgcgacgcggaaggcaccgagctctaactgcgcggttggtttctcgcagacggccaccaag

SEQ ID NO: 101 - DNA, 283 bp, Magnaporthe grisae
ggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctcagtactactgcctctccatcctcgacaaacatcaccatcccgat

SEQ ID NO: 102 - DNA, 250 bp, Magnaporthe grisae
tccagtttgcggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctca

SEQ ID NO: 103 - DNA, 270 bp, Magnaporthe grisae
atcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggtt

SEQ ID NO: 104 - DNA, 549 bp, Magnaporthe grisae
atgggtatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgccaacaccctcctcctccccaagaacgcccgtgaggctgtcaagcacttcggcttcggtccccacaagcacaagaagccttacgtccagtccaagggccgcaagttcgagaaggcccgtggtcgcagacgatcgcgtggtttcaaggtctaa

SEQ ID NO: 105 - DNA, 199 bp, Magnaporthe grisae
aagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgccaacaccctcc

SEQ ID NO: 106 - DNA, 276 bp, Magnaporthe grisae
actgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcg

SEQ ID NO: 107 - DNA, 284 bp, Magnaporthe grisae
ccaatcatctggtttcgagggcggcatcaacgaggacaacccttatgacaagccgctttttgctgttcaggacgccatcagtagtatctaccggccccgtgcgaacaacgatgatgaggacgaggcggctggcgatgcggagatggccaagatacaaaaggcgagcagatatggtgaggtgctaggccgaggtacattctccggtgccggggatgtggaagcccgagaaggtccagtgcagttcgaaaaggatgctgcaggcgcggaccctttcaatgtggaca

SEQ ID NO: 108 - DNA, 295 bp, Magnaporthe grisae
tatgctgaagcagaggcctccttcaagcgcttaagaacattggcaccgaatcggctggaggacatggaggtctattccacagtactttggcacctgaagaaggaaacagaggcatcgtttctggcacacgagcttgttgacatagcgtggcattcaccgcacgcctggtgcgccttgggcaatgcatggtcgctggcatcagatcgcgaacaagcgctgcggtgcttcaagcgtgctacgcagctcgacgcaaaatttgcatatgcctacacacttcaagggcatgagcactttg

SEQ ID NO: 109 - DNA, 291 bp, Magnaporthe grisae
cctgctccgaggctattgaccccagccagcacctcgagcctctgatccgctcgttgtttgctggcctgctaaacactcccaagatggccgcctcgtgctgttgggctctgatgaacctggcggaacgttttgccggtgagcccggagcgccccagaatgccatcactgcctacttcaacgacagtgtgcgcagcctcctggacgtcaccgccaagaacgattgcgactcggctgtcaggacggccgcgtatgaggttctcaacgctttcatcgtcaatgcggcaaacgatt

SEQ ID NO: 110 - DNA, 279 bp, Magnaporthe grisae
gtgacagggtcccatcttcaaacgtcggagccgctccctcggagcgttctgagcgtccctcggagcgccctgctcctgcccgaactggtacccccatggagcgcactgattcaaacgatcgtgctggtggtccgccccggcttaaccttgctcgtgctgacggtgccaagcccagctggcgtgaacgtgagcaggccaaggctagcggtggccctgagcgggatcttcctcccagcagggcggcttctggaaggggcccaccgatgcacaggaccgatt

SEQ ID NO: 111 - DNA, 600 bp, Magnaporthe grisae
gcctccggcaacaagcatgttccccgtgctgtcctcgtcgatctcgagcccggcaccatggacgccgtccgtgccggtccttttggccagctcttccgccccgacaacttcgtcttcggtcagtctggtgctggaaacaactgggccaagggtcactacactgagggtgccgagcttgtcgaccaggtccttgacgtcgtccgtcgtgaggctgagggctgtgactgcctccagggtttccagatcacccactccctgggtggtggtaccggtgccggtatgggtactctgctgatctccaagatccgcgaggagttccccgaccgtatgatggccaccttctcggtcgttccctcgcccaaggtttccgacaccgtcgttgagccctacaacgctaccctctcggtccaccagctggtcgagaactctgacgagaccttctgcattgacaacgaggctctgtacgacatctgcatgcgcaccctgaagctgtcgaacccctcatacggtgacctgaactacctggtttcggccgtcatgtctggcgtcaccacctgcttgcgtttccccggccagctcaactctgatctccgcaagctt

SEQ ID NO: 112 - DNA, 590 bp, Magnaporthe grisae
cgtcgtgaggctgagggctgtgactgcctccagggtttccagatcacccactccctgggtggtggtaccggtgccggtatgggtactctgctgatctccaagatccgcgaggagttccccgaccgtatgatggccaccttctcggtcgttccctcgcccaaggtttccgacaccgtcgttgagccctacaacgctaccctctcggtccaccagctggtcgagaactctgacgagaccttctgcattgacaacgaggctctgtacgacatctgcatgcgcaccctgaagctgtcgaacccctcatacggtgacctgaactacctggtttcggccgtcatgtctggcgtcaccacctgcttgcgtttccccggccagctcaactctgatctccgcaagcttgccgtcaacatggttcccttccctcgtctgcacttcttcatggttggcttcgctcctttgaccagccgtggtgcccactctttccgcgctgtcaccgttcccgagttgacccagcagatgttcgaccccaagaacatgatggctgcttctgacttcaggaatggtcgttacctgacctgctctgccatctt

SEQ ID NO: 113 - DNA, 393 bp, Magnaporthe grisae
cgtggaaaggtttccatgaaggaggtcgaggaccagatgcgcaacgtccagaacaagaactcgtcgtacttcgtcgagtggatccccaacaacatccagaccgctctctgctctatcccgccccgcggcctcaagatgtcgtcgactttcatcggaaactcgaccgccatccaggagctgttcaagcgtgtcggtgagcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 114 - DNA, 200 bp, Magnaporthe grisae
gcctccggcaacaagcatgttccccgtgctgtcctcgtcgatctcgagcccggcaccatggacgccgtccgtgccggtccttttggccagctcttccgccccgacaacttcgtcttcggtcagtctggtgctggaaacaactgggccaagggtcactacactgagggtgccgagcttgtcgaccaggtccttgacgtcgt

SEQ ID NO: 115 - DNA, 191 bp, Magnaporthe grisae
gccgtcaacatggttcccttccctcgtctgcacttcttcatggttggcttcgctcctttgaccagccgtggtgcccactctttccgcgctgtcaccgttcccgagttgacccagcagatgttcgaccccaagaacatgatggctgcttctgacttcaggaatggtcgttacctgacctgctctgccatctt

SEQ ID NO: 116 - DNA, 194 bp, Magnaporthe grisae
agttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 117 - DNA, 582 bp, Magnaporthe grisae
agttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtagagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtagagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 118 - DNA, 300 bp, Magnaporthe grisae
ctcgggaacaaggcagccgcctcagatggcatgccaaatatggtgatgccatatgaacctcaggaccccgctgtcatcgcagagatggtccgcgtgctcgatgagcatacaaagggtggcgccaagggtcgtttccgtatcaagaagaccaagtttgccgttactggttctccttccaaggtcactgtagattcctggaagctacaggactgggactacaagaaacctgggctgcctacatatgcccgtggcctcttcaccacgcgcctcccaaataatgtaccagaaattgccgtcaga

SEQ ID NO: 119 - DNA, 300 bp, Magnaporthe grisae
gcaggtgcatcgacggcgcgcgaatcccaggacgttgatcctctaattcacaacccgttcctgaagccgcccgacaaggcagcagtagaaagtaccctggttgcgttcgagcccgcgactttcaaattgactttacaaaatccgtatgaaatcgaggttgaaattgaaagcgtgcggttagacacggaaggggtcgagtttgaatcctctgtcgacagcgccctcattggcccatatcgcacgcagatacttcgtctagtcggcataccgaaggctgcggggtctctaaagattaccggc

SEQ ID NO: 120 - DNA, 300 bp, Magnaporthe grisae
ggtgatggaatggatgttcaacggccaggttgtagatgccatatttgaaacgatacaccaacagtccagcgatatcggaagcgtttcgcccgattcgcccttgatattgggcattatacgagctgttgaggtggtgtcgaaagttttggagcttcaggacacatatgttgatcttgtgcggcaagtcataaaacagcacacaggacaacgccatagacatgtgcctcacgcttcctacgcctccttcgaagaagggtttgctcatcacctcgaggtcgtcgcagatctcggccgatattg

SEQ ID NO: 121 - DNA, 300 bp, Magnaporthe grisae
ggcggcacgcgctcgaggcaaaacgtatccaggcctcactcaccaagggcgacacacagctttggcttggtactgcagacttggctttgcacatggtagatggcgcctatcaggattcacccgaggaaatcgacaagactttgaaagtagctatggactgctacaggagcgtattacagatcgacaagacaaaccccgttgctcgcctgggcaaagccgacatcctcgcggacttgggacagtccagcaaggccgttgctgcttatctcgactacctcaaacagaaaccttataatcttc

SEQ ID NO: 122 - DNA, 300 bp, Magnaporthe grisae
cgtggccgacgctgaatttgaaggggagatgagtgtcaaccccacagacttggttacacggccgggtgaaacgcgaacattcaagcccatcatgctggcgcatgggagtcaagcaggtacacgtgatgccttcctcaggttggtttccggtattggctcgccatctcagcaggcagatctggctaccgacatgatcagtctggcaagggatttgtcaggaatagatcaggtcacagccttatggctagcgtttgagttgctgaaagtagcactagccaagaacgagcaggacgagcagtt

SEQ ID NO: 123 - DNA, 300 bp, Magnaporthe grisae
ccgctcacacactgcggcccttcaacccgcaaaagcccgccggagcagccatcctcccgatcctcttaccgccagcaacactccgcccattggccttccggacctttaccaaaaaacacagcctgaccctcacatcgtctgctctacaagagctggcgtcctttgtcggccgacactgcggctcaggatggcgtgaggaagggctcgccgagcgtgtgctagaggaggtggcaaaatcgtggaaggctggcaatggcggggtgatagtcgatggggccagccccatcctgaaggacatcc

SEQ ID NO: 124 - DNA, 300 bp, Magnaporthe grisae
gtggcggtggcgatgccttaccaagcctggcctcctttgacgttggagcgaatggccaggagatctttgcggattactgcagtgatactatcgacattcttttgctctcgctggatggcaaagcacggatgatgaatggaaagaagccggttgtcggtgtcttcatagcaaacagtattgccatcaccgagcggtcgattcgcgagtctgatctggcgcctttgatggagacacgcctgggaatattggaaacataccgaaagaaggcgaagctttattacacagagccttgcaaggatg

SEQ ID NO: 125 - DNA, 300 bp, Magnaporthe grisae
tgatgttgtggaggaagagcaaaagcgatgccgcgagtgacgcgcgcaagcagctgcaaatgtccaaatccgtaccgcccagcggtcctctcctgaggagaaacacagagccactgcagttgatgtcaggccctaatcctcaagaccagaacggttccatatcgccatcgcctctcgcagcgaagcaggagtatgttgtgcaaacagaaagacggtcaagcgtctccacctatctgctatgccgtgtcctcctcgaggtcatcagccaaagcagtttgagtctgatcactcctgaaatgg

SEQ ID NO: 126 - DNA, 300 bp, Magnaporthe grisae
gagcgaagagacctcggaagcggcaaggtttgtcagtggcacgatctacgactcgataggatcacgcctgctcgaaacactcgtaagccattgcccaggcaagatattcaaaggcctgtggagtcacatcattgggcctcggtttgagacactcctccgtaacgagacggcaacatatgtagcaatgaaggcattggtcaggctgagtcgagaggacttggcggacgccgtgcttaagacgataccgaaagtggaaatgctagtgtcgaaaggccgcttcaatatcttgacgctgctgtt

SEQ ID NO: 127 - DNA, 300 bp, Magnaporthe grisae
actggtgactataggtgacccttcggaaatggtcgtagttctgacacaggccctgcagggtgtcgagatggacgcaaggggttgtcggtcgctcaacatgggcttgcacgttctgagggaagttgtcgatgcgcgtccggattttcatccgaccgaatctgaacttgccgccctgagcgggttggccgcgcgctgccttgaaagccatgagtctggcgtgcggatggatgcagtccaattgtgtgttgccctgcatgcccgtgtgggcgatacacgcttctgggacaacatcaagggtgt

SEQ ID NO: 128 - DNA, 292 bp, Artificial
  Synthetic Oligonucleotide
cgatatcttgtcaaacgcgttcgcgtacggaaacagagcattgaccaaatacccagacgatatagcagactatttcaagcagtcgtttcccgagggatattcctgggaaagaagcatgacttttgaagacaaaggcattgtcaccgtggaaactgacgtcagcatggaagacgactgctttatctataaaattcgttttgatggggtgaactttcctcccaatggtccagtaatgcagaagaaaactttgaggtgggaaccatccactgagattatgtacgttcgtgatggc

SEQ ID NO: 129 - DNA, 200 bp, Artificial
  Synthetic Oligonucleotide
acgatatcttgtcaaacgcgttcgcgtacggaaacagagcattgaccaaatacccagacgatatagcagactatttcaagcagtcgtttcccgagggatattcctgggaaagaagcatgacttttgaagacaaaggcattgtcaccgtggaaactgacgtcagcatggaagacgactgctttatctataaaattcgtttt

SEQ ID NO: 130 - DNA, 200 bp, Artificial
  Synthetic Oligonucleotide
atgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacaca

SEQ ID NO: 131 - DNA, 279 bp, Artificial
  Synthetic Oligonucleotide
ttatggtgttcaatgcttttcaagatacccagatcatatgaaacggcatgacttttcaagagtgccatgcccgaaggttatgtacaggaaagaactatatttttcaaagatgacgggaactacaagacacgtaagtttaaacagttcggtactaactaaccatacatatttaaattttcaggtgctgaagtcaagtttgaaggtgatacccttgttaatagaatcgagttaaaaggtattgattttaaagaagatggaaacattcttggacacaaattg

SEQ ID NO: 132 - DNA, 24 bp, Artificial
  Synthetic Oligonucleotide
gaattcatggacaccctggtagcc

SEQ ID NO: 133 - DNA, 24 bp, Artificial
  Synthetic Oligonucleotide
ctgcagcgttggtaaactcgccct

SEQ ID NO: 134 - DNA, 24 bp, Artificial
  Synthetic Oligonucleotide
cccgggatggacaccctggtagcc

SEQ ID NO: 135 - DNA, 24 bp, Artificial
  Synthetic Oligonucleotide
agatctcgttggtaaactcgccct

SEQ ID NO: 136 - DNA, 26 bp, Artificial
  Synthetic Oligonucleotide
gaattccgacctgctcgtctcacata

SEQ ID NO: 137 - DNA, 26 bp, Artificial
  Synthetic Oligonucleotide
ctgcagaggaagtaagggtgcagtgc

SEQ ID NO: 138 - DNA, 26 bp, Artificial
  Synthetic Oligonucleotide
cccgggcgacctgctcgtctcacata

SEQ ID NO: 139 - DNA, 26 bp, Artificial
  Synthetic Oligonucleotide
ccatggaggaagtaagggtgcagtgc

SEQ ID NO: 140 - DNA, 26 bp, Artificial
  Synthetic Oligonucleotide
gaattcggagtacatcatggcaaacg

SEQ ID NO: 141 - DNA, 25 bp, Artificial
  Synthetic Oligonucleotide
ctgcagatcgggatggtgatgtttg

SEQ ID NO: 142 - DNA, 26 bp, Artificial
  Synthetic Oligonucleotide
cccgggggagtacatcatggcaaacg

SEQ ID NO: 143 - DNA, 25 bp, Artificial
  Synthetic Oligonucleotide
ccatggatcgggatggtgatgtttg

SEQ ID NO: 144 - DNA, 34 bp, Artificial
  Synthetic Oligonucleotide
gaattcatgggtatcgatcttaagaagcaccacg

SEQ ID NO: 145 - DNA, 33 bp, Artificial
  Synthetic Oligonucleotide
ctgcagttagaccttgaaaccacgcgatcgtct

SEQ ID NO: 146 - DNA, 34 bp, Artificial
  Synthetic Oligonucleotide
cccgggatgggtatcgatcttaagaagcaccacg

SEQ ID NO: 147 - DNA, 33 bp, Artificial
  Synthetic Oligonucleotide
ccatggttagaccttgaaaccacgcgatcgtct

SEQ ID NO: 148 - DNA, 24 bp, Artificial
  Synthetic Oligonucleotide
gaattcactgcggccgcggcacag

SEQ ID NO: 149 - DNA, 24 bp, Artificial
  Synthetic Oligonucleotide
ctgcagcgcatccgcccgaccagc

SEQ ID NO: 150 - DNA, 24 bp, Artificial
  Synthetic Oligonucleotide
cccgggactgcggccgcggcacag

SEQ ID NO: 151 - DNA, 24 bp, Artificial
  Synthetic Oligonucleotide
ccatggcgcatccgcccgaccagc

SEQ ID NO: 152 - DNA, 26 bp, Artificial
  Synthetic Oligonucleotide
gaattcccaatcatctggtttcgagg

SEQ ID NO: 153 - DNA, 26 bp, Artificial
  Synthetic Oligonucleotide
acgcgttgtccacattgaaagggtcc

SEQ ID NO: 154 - DNA, 26 bp, Artificial
  Synthetic Oligonucleotide
cccgggccaatcatctggtttcgagg

SEQ ID NO: 155 - DNA, 26 bp, Artificial
  Synthetic Oligonucleotide
ccatggtgtccacattgaaagggtcc

SEQ ID NO: 156 - DNA, 26 bp, Artificial
  Synthetic Oligonucleotide
gaattctatgctgaagcagaggcctc

SEQ ID NO: 157 - DNA, 25 bp, Artificial
  Synthetic Oligonucleotide
ctgcagcaaagtgctcatgcccttg

SEQ ID NO: 158 - DNA, 26 bp, Artificial
  Synthetic Oligonucleotide
cccgggtatgctgaagcagaggcctc

SEQ ID NO: 159 - DNA, 25 bp, Artificial
  Synthetic Oligonucleotide
ccatggcaaagtgctcatgcccttg

SEQ ID NO: 160 - DNA, 24 bp, Artificial
  Synthetic Oligonucleotide
gaattccctgctccgaggctattg

SEQ ID NO: 161 - DNA, 24 bp, Artificial
  Synthetic Oligonucleotide
ctgcagatcgtttgccgcattgac

SEQ ID NO: 162 - DNA, 24 bp, Artificial
  Synthetic Oligonucleotide
cccgggcctgctccgaggctattg

SEQ ID NO: 163 - DNA, 24 bp, Artificial
  Synthetic Oligonucleotide
ccatggatcgtttgccgcattgac

SEQ ID NO: 164 - DNA, 26 bp, Artificial
  Synthetic Oligonucleotide
gaattcgtgacagggtcccatcttca

SEQ ID NO: 165 - DNA, 24 bp, Artificial
  Synthetic Oligonucleotide
ctgcagaatcggtcctgtgcatcg

SEQ ID NO: 166 - DNA, 26 bp, Artificial
  Synthetic Oligonucleotide
cccggggtgacagggtcccatcttca

SEQ ID NO: 167 - DNA, 24 bp, Artificial
  Synthetic Oligonucleotide
agatctaatcggtcctgtgcatcg

SEQ ID NO: 168 - DNA, 28 bp, Artificial
  Synthetic Oligonucleotide
gaattcgcctccggcaacaagcatgttc

SEQ ID NO: 169 - DNA, 34 bp, Artificial
  Synthetic Oligonucleotide
ctgcagaagcttgcggagatcagagttgagctgg

SEQ ID NO: 170 - DNA, 28 bp, Artificial
  Synthetic Oligonucleotide
cccggggcctccggcaacaagcatgttc

SEQ ID NO: 171 - DNA, 34 bp, Artificial
  Synthetic Oligonucleotide
agatctaagcttgcggagatcagagttgagctgg

SEQ ID NO: 172 - DNA, 29 bp, Artificial
  Synthetic Oligonucleotide
gaattcccgtcgtgaggctgagggctgtg

SEQ ID NO: 173 - DNA, 33 bp, Artificial
  Synthetic Oligonucleotide
ctgcagaagatggcagagcaggtcaggtaacga

SEQ ID NO: 174 - DNA, 29 bp, Artificial
  Synthetic Oligonucleotide
cccgggccgtcgtgaggctgagggctgtg

SEQ ID NO: 175 - DNA, 33 bp, Artificial
  Synthetic Oligonucleotide
ccatggaagatggcagagcaggtcaggtaacga

SEQ ID NO: 176 - DNA, 32 bp, Artificial
  Synthetic Oligonucleotide
gaattcccgtggaaaggtttccatgaaggagg

SEQ ID NO: 177 - DNA, 28 bp, Artificial
  Synthetic Oligonucleotide
ctgcagctactcctcgccctcaagaggg

SEQ ID NO: 178 - DNA, 32 bp, Artificial
  Synthetic Oligonucleotide
cccgggccgtggaaaggtttccatgaaggagg

SEQ ID NO: 179 - DNA, 28 bp, Artificial
  Synthetic Oligonucleotide
ccatggctactcctcgccctcaagaggg

SEQ ID NO: 180 - DNA, 25 bp, Artificial
  Synthetic Oligonucleotide
gaattcagttcactgccatgttcag

SEQ ID NO: 181 - DNA, 24 bp, Artificial
  Synthetic Oligonucleotide
ctgcagctactcctcgccctcaag

SEQ ID NO: 182 - DNA, 25 bp, Artificial
  Synthetic Oligonucleotide
cccgggagttcactgccatgttcag

SEQ ID NO: 183 - DNA, 24 bp, Artificial
  Synthetic Oligonucleotide
ccatggctactcctcgccctcaag

SEQ ID NO: 184 - DNA, 831 bp, Magnaporthe grisae
atggacaccctggtagcccgctacagccgcccggcttaccagcagaacgagacattcacagaagatgatcagcaagacctttgcgattccgtcccaagtctttcactcaagtttgcggttccgctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatgggtaccatgtgcgccggcgtcaccaaggaggagggtcccgccctgtactacatcgacagcgacggcaccaggcttgccggcaatctgttctgtgtgggatccggtcagacctttgcctatggtgtgctggatgccgagtacaagtacgacctgtcggatgaggatgcgctcgagctcggccgcaggagcattctcgccgccacccacagggatgcctactccggtggttttatcaacttgtaccacgtcaaggaggacggttgggtcaagcacggattcaacgacacgaaccctatcttctggaagactaagctggagaagggcgagtttaccaacgttacgagtgcgctggactag

SEQ ID NO: 185 - DNA, 1831 bp, Magnaporthe grisae
accgtacatgatgcaatcgatgcatctttgagctgcttgatttgatagggacggatttactccgaaccacagcagcgacaggaattagacgagtgtcgccaattgagttggtatgagctgcctccaataggagaaatcaaatgatagtgggtctgcccgtgggggacagacagagctactccggaccagcttgaatttcaggctctcaggcagcaacttggagctttcattcacaaggacgcgtgcatgggtctgcctgagccagagcttcggactgcctgcgtcaatcgaggtgtacgtcttatggaacccacctaacctcaccaccatcaacgtccccatcgatatcacaactgcgttcccctctatccacccgcatcgagaccataattcaacattggaagattctcacctcgggaagtcttccgctttcgaaagtgatacttaattctacatccatcacataaatattggcgccacgacgccggagactcgccgccatggacaccctggtagcccgctacagccgcccggcttaccagcagaacgagacattcacagaagatgatcagcaagacctttgcgattccgtcccaagtctttcactcaagtttgcggttccgctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatgggtaccatgtgcgccggcgtcaccaaggaggagggtcccgccctgtactacatcgacagcgacggcaccaggcttgccggcaatctgttctgtgtgggatccggtcagacctttgcctatggtgtgctggatgccgagtacaagtacgacctgtcggatgaggatgcgctcgagctcggccgcaggagcattctcgccgccacccacagggatgcctactccggtggttttatcaacttgtaccacgtcaaggaggacggttgggtcaagcacggattcaacgacacgaaccctatcttctggaagactaagctggagaagggcgagtttaccaacgttacgagtgcgctggactagatgtttaacgaattatggcagtatgattgccttatttcaagcgtcgactcgggtctaggcatggcattgggaacaggatgacggctgtgacgaatcacaaaaaagttactcaagctgggtgtgatggtgggcaacgggatactctgttgtctggtccccgtgcgtgcacaggaatccgtaccattttctcatctttccctttcccccttttttttccggaaggcgaatgtctcaacaacgtgtactcaaaagacaccaggatcgttttacaggaattggcgcttggtgacaggccggttttagacaacccatctagctgattatgcaagttggacgaatcattcctcagtaggtcacgatgatataattgccagagaaattctgtgaagagccgccaaggtttgtagttatacttgacttgatttccatactgcacattagggctgccagtacctactcgctgtcattgccgtcgtcgagagcttcatcttcctcttccg

SEQ ID NO: 186 - DNA, 549 bp, Magnaporthe grisae; identical to SEQ ID NO: 104

SEQ ID NO: 187 - DNA, 1382 bp, Magnaporthe grisae
agcctttgctgtaatttattttgtatgagtttcatttgtggttgagctaataagagttagacattgtagaatgaagtttcgacttattggaagccttgctgtgcctaatctgacggaggcaattgggacctgaccaagagggacggttccaggatcaaaatgcatcttgactcgttagacccgcagcacgtgagcgccctgaattatctcttgttgcagcgcggccgtgttttacgcagtcaattagcgtaggattaatgccttacatgtcaggcgcaaagcgaaagacacacacgaaaaggagctgccctaattctgcccagccgaatttcaccgccccgccgctcgcgaattgccccacaagcgcaccaccacaacgaaatttccattggcatcgtgggccgtttgcaacttttttgttctccctctccaactaaccagcagcaaatcaaccgcccacccgtcctcgtagatcagcgacatcgcgagacgccgacaagatgggtatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgccaacaccctcctcctccccaagaacgcccgtgaggctgtcaagcacttcggcttcggtccccacaagcacaagaagccttacgtccagtccaagggccgcaagttcgagaaggcccgtggtcgcagacgatcgcgtggtttcaaggtctaaatggccttgtcatcctcttttggggtctctttttgtttttattcaatgggcttgttactgctggctgttctcgtgggttgacgcaagaaaacgatatccatgttgtctcttacggtcgtctttggggactctttagtcagtactctcaaacaacaggagtttgcatgggtttcggcgtggaaatgggcaacaaaagaatattcatgaactttcggaatgcaaatatgaaattgagatgccctgaggcccttgaatcttatactatttgcgtgtatggctgtgttgtatgtgctagtgcaagtgaacaatctgtagggagcaatgtgatgtgga

SEQ ID NO: 188 - DNA, 1569 bp, Magnaporthe grisae
atggcgaccaacggcgatgctgctcccccggcgccggcggcagagacggcagctgcgactgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcggccgcgttggcggccgccaagctggcagagcagaacaaggagccccagggcccgcccaagccgccggattttgagttctcggcgcgcatgccgaggatgaaccagaaggatcttgagatattgagggtcacggcgctgttcgtggccaggaacggaaggcaatttcagacccagctaatgcaacgcgagactaagaatccgcagtttcagtttcttatcccgaatcacaccttccacaatttcttccagcatatggtagatcagtacgccatcatactcaaggagagtggcatgggaggggatggatctaaggcccaggagcagcgaattgagcagctgcggcgcaatgtcgaggatcggttccacattctggagagggcaaaacagcgggctgagtatgcagtatggcaggagcaggagaggcagaagcaggaggctgccgaggagaagaagaaggatgactttgcacgcatcgactggaatgactttgtcgtggttgagactattgatttcaccgaggcagatgccaatattaccctcccaccgccgacgactctcaacgacatacaatacgcatcattggaggagaagcaaaacttctcagtcaacgccaagcgtatcgaagaggcattcccctttgatgataccagctacaatgcctatccggtacagcaacagcaatcacaaccagcacaacaagactcaccggcaggggcaccggcacagccggcacacatgcagcaggaccccgaggagacgcggaggatacaagaaagggaacaagcccgggcgcgcatgcaccaagcccaggcagatgccagaggaggaacggctccaatgaagatcaaggaaaactacgtacccaaagcggctgcccggggtccgaggaccggaggccagacggctctgtgtccaagatgtaaccagcagatcctcttgtcggagtgggaggagcacatgaggatcgaactgctggatcccaggtggaaggagcaaaaggccaaggcagagtcgcgatacgcgacgaccaacatatcgacggcggatgtggccaacaacctgaagcgtctggcgagccaaaggacggacgtgttcgacagcgtcacgggccagccgctctcggaggaggagatggcccgtcgcaaaaaggcagccatcaacagctacgatggaaaccccgacggcaagagccaggcgcacattgcacacctgcagcacgtcaatgtcgaggagcag

SEQ ID NO: 189 - DNA, 2589 bp, Magnaporthe grisae
gtaggagctcacatgaaaggcctcatgtctgatggctggcttctatggtagttcactatgtataccttagggctagagtacaagtgcagggtaggtagtaagacagtcactttgattgtggtgcagggtaggtacgcgtatgtggctgtcaagcacggacccatatacgtgcgacaacggaccactgtcaataatttttgctgttggaaacggacgcgactgatatccaccgcgacaagtaacgccgacccacccagccgacaacctaccgtcgcaacttcgatcaatacatcacgtttgacgcagcggaatccggcaagatacgaatccttcatcaggatatcgatccgcaacaccaatggacacatattgagcagcggactcaattcgtaaggactaccagatcgagccgagcgacatagagcagaggacaagaaaacctcgtcgtagtaggccaaggccaaccccgtctcccgaaaacaaacagtcgcgcttgcaacatggcgaccaacggcgatgctgctcccccggcgccggcggcagagacggcagctgcgactgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcggccgcgttggcggccgccaagctggcagagcagaacaaggagccccagggcccgcccaagccgccggattttgagttctcggcgcgcatgccgaggatgaaccagaaggatcttgagatattgagggtcacggcgctgttcgtggccaggaacggaaggcaatttcagacccagctaatgcaacgcgagactaagaatccgcagtttcagtttcttatcccgaatcacaccttccacaatttcttccagcatatggtagatcagtacgccatcatactcaaggagagtggcatgggaggggatggatctaaggcccaggagcagcgaattgagcagctgcggcgcaatgtcgaggatcggttccacattctggagagggcaaaacagcgggctgagtatgcagtatggcaggagcaggagaggcagaagcaggaggctgccgaggagaagaagaaggatgactttgcacgcatcgactggaatgactttgtcgtggttgagactattgatttcaccgaggcagatgccaatattaccctcccaccgccgacgactctcaacgacatacaatacgcatcattggaggagaagcaaaacttctcagtcaacgccaagcgtatcgaagaggcattcccctttgatgataccagctacaatgcctatccggtacagcaacagcaatcacaaccagcacaacaagactcaccggcaggggcaccggcacagccggcacacatgcagcaggaccccgaggagacgcggaggatacaagaaagggaacaagcccgggcgcgcatgcaccaagcccaggcagatgccagaggaggaacggctccaatgaagatcaaggaaaactacgtacccaaagcggctgcccggggtccgaggaccggaggccagacggctctgtgtccaagatgtaaccagcagatcctcttgtcggagtgggaggagcacatgaggatcgaactgctggatcccaggtggaaggagcaaaaggccaaggcagagtcgcgatacgcgacgaccaacatatcgacggcggatgtggccaacaacctgaagcgtctggcgagccaaaggacggacgtgttcgacagcgtcacgggccagccgctctcggaggaggagatggcccgtcgcaaaaaggcagccatcaacagctacgatggaaaccccgacggcaagagccaggcgcacattgcacacctgcagcacgtcaatgtcgaggagcaggcatcgccgttggtcgccatttctgcgtaacagcagggtaatgatggtgttgcacttttttatgtttgaaactgctatggtgttcgtcttatactgccaagcttgctaacaacttgacctatttatgtacaaaacaagatcacggttactgctgcccaagaaagggcttccaacaaagggcatgtctcattggtgcgtcaatctagaacgctagtataagttcgtcacgtacgtatttaggtatctgactgtccatcactggcgatctcgatgagtccaaaatttgccttgaagccaagattcgctaaggcacccttgattaccgaataccacctagaatccaatggggagtaccatgttctaccgccccgccgacgcctactatacaatacaaacgcggcgtgcggtgcattgcatacgaagcatatataagactcgggcaatgtaagagtttgcggcaggcacccgatcgcccccacatttagatgatttcaaatggtgcaatattccgttgacagtt

SEQ ID NO: 190 - DNA, 720 bp, Magnaporthe grisae
cttcttgaccgtctgcgaagcaatccagttgccggcggtggcacgagagtcggtcgcaacgatgatgcctccctgaaacctgaaagcgagcgtcgtcgttccgtgtgcgatcttgatggggcagtttgggtttgcgtggtcgtccgttgctgtgcggagcggaaccgcaaacttgagtgaaagacttgggacggaatcgcaaaggtcttgctgatcatcttctgtgaatgtctcgttctgctggtaagccgggcggctgtagcggctaccagcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcctggtagccgctacagccgcccggcttaccagcagaacgagacattcacagaagatgatcagcaagacctttgcgattccgtcccaagtctttcactcaagtttgcggttccgctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaag

SEQ ID NO: 191 - DNA, 1798 bp, Magnaporthe grisae
cgttggtaaactcgcccttctccagcttagtcttccagaagatagggttcgtgtcgttgaatccgtgcttgacccaaccgtcctccttgacgtggtacaagttgataaaaccaccggagtaggcatccctgtgggtggcggcgagaatgctcctgcggccgagctcgagcgcatcctcatccgacaggtcgtacttgtactcggcatccagcacaccataggcaaaggtctgaccggatcccacacagaacagattgccggcaagcctggtgccgtcgctgtcgatgtagtacagggcgggaccctcctccttggtgacgccggcgcacatggtacccatgctgaggcccatgcccttgtactggtagacgaggttggcgagaatcttggaggcggcggcgaccgagatgcggcgcttgtggcggagctcgtgcagacggcactgcatgcccagccaggcgagccagtactggcagtctgcggcaccgccggccatggtgccgagcaggcaagagttgatctcgatgaccttcttgaccgtctgcgaagcaatccagttgccggcggtggcacgagagtcggtcgcaacgatgatgcctccctgaaacctgaaagcgagcgtcgtcgttccgtgtgcgatcttgatggggcagtttgggtttgcgtggtcgtccgttgctgtgcggagcggaaccgcaaacttgagtgaaagacttgggacggaatcgcaaaggtcttgctgatcatcttctgtgaatgtctcgttctgctggtaagccgggcggctgtagcgggctaccagggtgtccatcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcatggacaccctggtagcccgctacagccgcccggcttaccagcagaacgagacattcacagaagatgatcagcaagacctttgcgattccgtcccaagtctttcactcaagtttgcggttccgctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatgggtaccatgtgcgccggcgtcaccaaggaggagggtcccgccctgtactacatcgacagcgacggcaccaggcttgccggcaatctgttctgtgtgggatccggtcagacctttgcctatggtgtgctggatgccgagtacaagtacgacctgtcggatgaggatgcgctcgagctcggccgcaggagcattctcgccgccacccacagggatgcctactccggtggttttatcaacttgtaccacgtcaaggaggacggttgggtcaagcacggattcaacgacacgaaccctatcttctggaagactaagctggagaagggcgagtttaccaacg

SEQ ID NO: 192 - DNA, 752 bp, Magnaporthe grisae
aggaagtaagggtgcagtgcctcctcgagggtcggttggcggaaggtcgcgcgatcaggaatatcgcccataagaagctcaaccaccagcaaaagcttggtggccgtctgcgagaaaccaaccgcgcagttagagctcggtgccttccgcgtcgcagccgtcaggtgctcgtgtgcctccgtgtagcgcagctgtatggcgcgaatccgaccaaggtagtagagataccgcgcaacttggttgtttgcagcattctcggggaactgtgtatgtgagacgagcaggtcgcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattccgacctgctcgtctcacatacacagttccccgagaatgctgcaaacaaccaagttgcgcggtatctctactaccttggtcggattcgcgccatacagctgcgctacacggaggcacacgagcacctgacggctgcgacgcggaaggcaccgagctctaactgcgcggttggtttctcgcagacggccaccaagcttttgctggtggttgagcttcttatgggcgatattcctgatcgcgcgaccttccgccaaccgaccctcgaggaggcactgcacccttacttcct

SEQ ID NO: 193 - DNA, 742 bp, Magnaporthe grisae
atcgggatggtgatgtttgtcgaggatggagaggcagtagtactgagcatatccatgcgcagcatatgggaccggcgccagagccgcaaggtagtccagccagtagaggctcggcttgtgtgtgatggggtcgacaccgcccaagaggaggttgactgtgtatggcttccgcgacctcaagctcgaggcaagctcgccacggacgtaatgcgccaatgcggacggtgaaagatcggtctcgttacgcatcgaatagagcttcgcgtttgccatgatgtactccccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcgggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctcagtactactgcctctccatcctcgacaaacatcaccatcccgat

SEQ ID NO: 194 - DNA, 716 bp, Magnaporthe grisae
aaccaggcggttgtcgtcggtgacggtgccgacaacgacaacggtcttcttctcgttgccgttcttcaggttgcctgcgatgcgcgacagggagacgggagggcggttggtgcgcgacataaagaggcggcgaaggacaaccttgttgaagctggagtcggtcctgcgggccaggaagcggtagagcttcaccaagagcttgaggtagacattgtcgctcttgggggccttgcggtgcgtgctgcgcacgtggtgcttcttaagatcgatcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggtt

SEQ ID NO: 195 - DNA, 1286 bp, Magnaporthe grisae
ttagaccttgaaaccacgcgatcgtctgcgaccacgggccttctcgaacttgcggcccttggactggacgtaaggcttcttgtgcttgtggggaccgaagccgaagtgcttgacagcctcacgggcgttcttggggccgcggaggaggagggtgttggcaccagtgggcttctcaagagccagctggtcaagggtgatggcctggccgccggcggcaacgatgcgggcacgggcggtggcggtgaagcgaagggcagcgacctgggccttggggcactcaaccaggcggttgtcgtcggtgacggtgccgacaacgacaacggtcttcttctcgttgccgttcttcaggttgcctgcgatgcgcgacagggagacgggagggcggttggtgcgcgacataaagaggcggcgaaggacaaccttgttgaagctggagtcggtcctgcgggccaggaagcggtagagcttcaccaagagcttgaggtagacattgtcgctcttgggggccttgcggtgcgtgctgcgcacgtggtgcttcttaagatcgatacccatcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcatgggtatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgccaacaccctcctcctccgcggccccaagaacgcccgtgaggctgtcaagcacttcggcttcggtccccacaagcacaagaagccttacgtccagtccaagggccgcaagttcgagaaggcccgtggtcgcagacgatcgcgtggtttcaaggtctaa

SEQ ID NO: 196 - DNA, 728 bp, Magnaporthe grisae
cgcatccgcccgaccagccgccagcgccgtgccacgcccggccttgtactcggccttgcgccactcgtagtacggattgtacgcgtcgctctggctcgtgacgaagctgaactttgggttcccgctgtggttctcgcgtaggcgctgctcgatgcccagtccaccacgcgccacgtacccggccgtcttttcaatcacctcgcggatctcaccgggtggcggaatgatgacgccctcgggaggcctgaggccgtcgagctgtgccgcggccgcagtcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcactgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcg

SEQ ID NO: 197 - DNA, 744 bp, Magnaporthe grisae
tgtccacattgaaagggtccgcgcctgcagcatccttttcgaactgcactggaccttctcgggcttccacatccccggcaccggagaatgtacctcggcctagcacctcaccatatctgctcgccttttgtatcttggccatctccgcatcgccagccgcctcgtcctcatcatcgttgttcgcacggggccggtagatactactgatggcgtcctgaacagcaaaaagcggcttgtcataagggttgtcctcgttgatgccgccctcgaaaccagatgattggcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcccaatcatctggtttcgagggcggcatcaacgaggacaacccttatgacaagccgctttttgctgttcaggacgccatcagtagtatctaccggccccgtgcgaacaacgatgatgaggacgaggcggctggcgatgcggagatggccaagatacaaaaggcgagcagatatggtgaggtgctaggccgaggtacattctccggtgccggggatgtggaagcccgagaaggtccagtgcagttcgaaaaggatgctgcaggcgcggaccctttcaatgtggaca

SEQ ID NO: 198 - DNA, 766 bp, Magnaporthe grisae
caaagtgctcatgcccttgaagtgtgtaggcatatgcaaattttgcgtcgagctgcgtagcacgcttgaagcaccgcagcgcttgttcgcgatctgatgccagcgaccatgcattgcccaaggcgcaccaggcgtgcggtgaatgccacgctatgtcaacaagctcgtgtgccagaaacgatgcctctgtttccttcttcaggtgccaaagtactgtggaatagacctccatgtcctccagccgattcggtgccaatgttcttaagcgcttgaaggaggcctctgcttcagcatacccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattctatgctgaagcagaggcctccttcaagcgcttaagaacattggcaccgaatcggctggaggacatggaggtctattccacagtactttggcacctgaagaaggaaacagaggcatcgtttctggcacacgagcttgttgacatagcgtggcattcaccgcacgcctggtgcgccttgggcaatgcatggtcgctggcatcagatcgcgaacaagcgctgcggtgcttcaagcgtgctacgcagctcgacgcaaaatttgcatatgcctacacacttcaagggcatgagcactttg

SEQ ID NO: 199 - DNA, 734 bp, Magnaporthe grisae
aatcggtcctgtgcatcggtgggccccttccagaagccgccctgctgggaggaagatcccgctcagggccaccgctagccttggcctgctcacgttcacgccagctgggcttggcaccgtcagcacgagcaaggttaagccggggcggaccaccagcacgatcgtttgaatcagtgcgctccatgggggtaccagttcgggcaggagcagggcgctccgagggacgctcagaacgctccgagggagcggctccgacgtttgaagatgggaccctgtcaccccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcgtgacagggtcccatcttcaaacgtcggagccgctccctcggagcgttctgagcgtccctcggagcgccctgctcctgcccgaactggtacccccatggagcgcactgattcaaacgatcgtgctggtggtccgccccggcttaaccttgctcgtgctgacggtgccaagcccagctggcgtgaacgtgagcaggccaaggctagcggtggccctgagcgggatcttcctcccagcagggcggcttctggaaggggcccaccgatgcacaggaccgatt

SEQ ID NO: 200 - DNA, 756 bp, Magnaporthe grisae
atcgtttgccgcattgacgatgaaagcgttgagaacctcatacgcggccgtcctgacagccgagtcgcaatcgttcttggcggtgacgtccaggaggctgcgcacactgtcgttgaagtaggcagtgatggcattctggggcgctccgggctcaccggcaaaacgttccgccaggttcatcagagcccaacagcacgaggcggccatcttgggagtgtttagcaggccagcaaacaacgagcggatcagaggctcgaggtgctggctggggtcaatagcctcggagcaggcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattccctgctccgaggctattgaccccagccagcacctcgagcctctgatccgctcgttgtttgctggcctgctaaacactcccaagatggccgcctcgtgctgttgggctctgatgaacctggcggaacgttttgccggtgagcccggagcgccccagaatgccatcactgcctacttcaacgacagtgtgcgcagcctcctggacgtcaccgccaagaacgattgcgactcggctgtcaggacggccgcgtatgaggttctcaacgctttcatcgtcaatgcggcaaacgat

SEQ ID NO: 201 - DNA, 564 bp, Magnaporthe grisae
ctactcctcgccctcaagaggggcctcctcctcgtactcctcttcctcctcgtcaacaccagcatcctggtactgctggtactcggaaacaagatcgttcatgttggactcggcctcagtgaactccatctcgtccataccctcaccagtgtaccaatgcaagaaagccttgcgcctgaacatggcagtgaactcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 202 - DNA, 1339 bp, Magnaporthe grisae
ctactcctcgccctcaagaggggcctcctcctcgtactcctcttcctcctcgtcaacaccagcatcctggtactgctggtactcggaaacaagatcgttcatgttggactcggcctcagtgaactccatctcgtccataccctcaccagtgtaccaatgcaagaaagccttgcgcctgaacatggcagtgaactctactcctcgccctcaagaggggcctcctcctcgtactcctcttcctcctcgtcaacaccagcatcctggtactgctggtactcggaaacaagatcgttcatgttggactcggcctcagtgaactccatctcgtccataccctcaccagtgtaccaatgcaagaaagccttgcgcctgaacatggcagtgaactctactcctcgccctcaagaggggcctcctcctcgtactcctcttcctcctcgtcaacaccagcatcctggtactgctggtactcggaaacaagatcgttcatgttggactcggcctcagtgaactccatctcgtccataccctcaccagtgtaccaatgcaagaaagccttgcgcctgaacatggcagtgaactcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcaggaattcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtagagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtagagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 203 - DNA, 760 bp, Magnaporthe grisae
gccatcacgaacgtacataatctcagtggatggttcccacctcaaagttttcttctgcattactggaccattgggaggaaagttcaccccatcaaaacgaattttatagataaagcagtcgtcttccatgctgacgtcagtttccacggtgacaatgcctttgtcttcaaaagtcatgcttctttcccaggaatatccctcgggaaacgactgcttgaaatagtctgctatatcgtctgggtatttggtcaatgctctgtttccgtacgcgaacgcgtttgacaagatatcgcccggggagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagggaattccgatatcttgtcaaacgcgttcgcgtacggaaacagagcattgaccaaatacccagacgatatagcagactatttcaagcagtcgtttcccgagggatattcctgggaaagaagcatgacttttgaagacaaaggcattgtcaccgtggaaactgacgtcagcatggaagacgactgctttatctataaaattcgttttgatggggtgaactttcctcccaatggtccagtaatgcagaagaaaactttgaggtgggaaccatccactgagattatgtacgttcgtgatggc

SEQ ID NO: 204 - DNA, 164 bp, Artificial
  Synthetic Oligonucleotide
gagctcaggtaagtgtacacactacattttcatgaacattattgcgaccgttgagattctcattgtttggtgattgattatctaaagtagaagcatgaatagatataacataattcgaaaactaatgggttagttatggggtaccttcatgcttttctctcagg

SEQ ID NO: 205 - DNA, 10018 bp, Artificial
  Synthetic Oligonucleotide
gaatttctagttctagataagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaaggccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctctcgagatctatcgatgcatgccatggtacccgggagctcgaattcgaagcttctgcagacgcgtccctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaattcggcgttaattcagtatcggatccccctcggactagaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaaagtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcattctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccgcggtgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattaattcgggggatctggattttagtactggattttggttttaggaattagaaattttattgatagaagtattttacaaatacaaatacatactaagggtttcttatatgctcaacacatgagcgaaaccctataggaaccctaattcccttatctgggaactactcacacattattatggagaaactcgagcttgtcgatcgacagatccggtcggcatctactctatttctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagtcgtggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatagcctccgcgaccggttgtagaacagcgggcagttcggtttcaggcaggtcttgcaacgtgacaccctgtgcacggcgggagatgcaataggtcaggctctcgctaaactccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatctcattgcccccccggatctgcgaaagctcgagagagatagatttgtagagagagactggtgatttcagcgtgtcctctccaaatgaaatgaacttccttatatagaggaaggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttatcacatcaatccacttgctttgaagacgtggttggaacgtcttctttttccacgatgctcctcgtgggtgggggtccatctttgggaccactgtcggcagaggcatcttgaacgatagcctttcctttatcgcaatgatggcatttgtaggtgccaccttccttttctactgtccttttgatgaagtgacagatagctgggcaatggaatccgaggaggtttcccgatattaccctttgttgaaaagtctcaatagccctttggtcttctgagactgtatctttgatattcttggagtagacgagagtgtcgtgctccaccatgttggcaagctgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattac

SEQ ID NO: 206 - DNA, 4257 bp, Aspergillus nidulans
atgttctctccgctagcgttcccgacgggcattatcctatatgacctttcgttctccatgccccctatatcgcacctagaactgtatccatttgaaatatttagagagccactggtggttcttgcaattgccgacgggacggagctcaccggcgatacaacccagacgggtcccgaatcgagtacagacaagccatcgaagccgaaaggactcgaacaacttgaacaggaactcgatctattaagagaaaagaatccaagggcactggtacatcagctcctcatatttgactacgaaggggtcagcaaggtctctaatggcccggataacatactatggattccgcccccgcaggtttccaaagctactacgatgaagactgtcctgtgcgatatcacgtctctcgtcctttctgaaatggacgaatttgcgaagacaattcaaagtataccaaccattgattccccgaaagcctcatcttgggggccacatcgcgggccagatttgcgccggcgtccgacagacaagctgtttcataggaagacaatgcctgcgcttgcaagcacaaacggcacttcggagactgctcaaggctcgacccaaagttcgccggcacctgaagatcatgagacgccgacaacattcgacgagatcactcgttccatacagctggctagtcggtccagcaccaccctagggaaaccaggatcactgccatcatccaaagaacacagtagggatcgcttgtcagtgagcggcttgagcgcaacagatcgaacaaaaaatcgaataaagggtcgctcgggtgtggtgatagggacactttttcttcaatctggccggtggccggatgcactgaaggaactagttgaggccgcatctaacgctagagcaagtagcgattatgtgtggcatgccaaagccctcgagtcaattctcctctgtttactgatgttcgcctgggctggcatggactttcaggttcctccaatctgttatcctgttgcggacaaatcttctaaggcatcggcagcaatcgttttcgatccaacctcgagtcaatcagccgggaatcgaatcatctctctccaaaatctttcaaaccttctaccggacctggcaaacaatattttgaatttatatacccgcgcagccaatatcacagatgagcctcttccccagctcgtcttctccgagacggttatccgtctttcaaggttattagtagccacacgcatccgcgacggggccttggatgacaacgctttgaagcatattgtaatgaatgagccgctagagcctctcgttcggccggagcgtcctcttggtctgacaattcttcggaagaacgaaattgcaaacttcctgttccgtgcgttgccgttttctgctggctcggatttgcctgcgacagatgccatacctatcctcataggcgttgtctctgtcttgaacgcgcttgacctgccacggaaaaaggcatttgttctgagggagctactttctatcctggttccagctctagtaacagcccgcaaaattggggctgcagaagtgggcattcatcctgcagcgggcttatcatctctcagtgatactgctttcgacataaatgcccttgatgttggcccggggaatatgaaccgtagcatgcgttcgcttctcgctacgataggagagatatacggcgtgcagtcttcatctcaaattgaactggggaagcgaacgtcggttggcggcaataattcccagagcccggactcaatcacagcaatcaccgaacgggccttccggcacattgtgctggatcgctacggtgatttgaatcttaaaattgatgttctcaagatgtgcatcaactcatgtgaagcgctcccagattttggtggtgtcctgcggtttactgtcgagctcctccagacgattcgcggggatctcatgctctctaaatcttcctacaccgcaccttgcctgcagcctgatgagcagatccgcctactgaacaatatcaagcgaactgttggtgctgccaaccggcttggtgtagcaggccttgaagccgaatattgggacgacttcttggttcggggggttgagttgttatctttatctgatcctaagaggcctgttcgtcgatctaagtcagagctcgatgctgtcactgcgacgagtgagaagtccaaaaaggatcccttcttatacaacccgttcacgaaatcagcgaataaagcttcggagcttctcatggttgctggagagcatgcagctttccaagtcactcttcagaacccttatgaatttgaagtcgagattgaacggatacgccttgagagcgagggtgtacccctggatgctgtggcggagtatatactgcttccaccattgtgtcttcaagatgtcacagtgtacggtatcgcacaagaagagggcacattaaaggtaactggttgctctgttaaagttcgatactgcagagagcgaagctttcctatatttaaagatttctggaagcccgatatagaagccaagttcaaacgcaccgggttagctgctaaaaagccttctgttgatcgtcctttatcctggagctcgacattctccaaggatggaaaaccaagcacaaagaaaggacctgaaacgttctcctgtgaggtgaaggttattcggccgcagccatcgctcgtggtcgagtcattgtcgttgtcccaatctgcagttatgattctcgagggggagaggtcatctttcaccattacattgcgtaatacatcatcttgcgacctggatttcatcttgttcacttttcaggactcaacgactaagcaaatacagacagcgctgagtaataaggacttgctgccaattgaagtgtacgagttggccttgaagctcacaaggccggccctgcaatggcgcagagagggattgaaccctagtgattactccatcccagcaggacagtgcgcaacgttcactatcgatgttgttggaaaccctgggcttcaggaagctaccgtgcagatcgactattgcagcattggagtatcttatgaggcactacctgacaccttttatactagacagctctttatcccccttaccgcaacggtaaacgcaagtctggagattgcccgttgtgatatattacctttcagtagcgattttgcatggtcgaacgacccgaattccgccagcgcgacgcttgattcttcagattccgccagcagcgatcacttctcaacagtgctctctaatcttgcccgaggaacatatggctccgaccactgcatactcctccttgaccttcggaacgcttggcccaatccgctctcggtggctttacacgttacggatgtacctcatgagtcacccgacagggctgccgcgcctactgacggagccggtcgatacactctccgtgagacccttcaacccggacaaacctctcgtttcgttctcgttgtaccgcgggtttacatccagaatcctcatgcatcaatcccctctctgaatacgggatcaaaaagacagtttgttgtcagcgcgcataagctcacgtttgatgctgaagcggcggcgcgggaggcattctggtatcgtgaagaacttctcaagagagtcagcggatcatggaaggaggctctgggcaatcgtgaagggacgattgatttaagaaacatgcgcttcactgcgcgcatggtggacgcattcaggctagaggacgtggagacgagcttctcattgaagccttcattctccggtagcgccaaaaatggcgtgtccgacctcgtaatccaaactgggaattcaagatacagagttggaaccgatgagatgttggatcttaccgttactgtccacaaccgctcctccagacctattcacccccttctgcgactccagcccagcctctgcaaccagccaagcaacgttgcgcttgacctccccagacgtcttgcttggacagggatgctgcagcaggtccttcccgtgctaaacagcggcgaaagcactagtactaccgtcggcgtcacgatcctctgccgaggtgagtacgaattcggcgccacagttgaggaactacgactgctacgtctcccatctgaaactgaggggaacaaaatcacctcggatgatgcgtctacacccataccgtacgaggaagggtttatcacggacacctttggcgcggacatggcgaagaaacgacggatctggcatgccagagatacgtgtgttatgactgctcatgattaa

SEQ ID NO: 207 - DNA, 1593 bp, Gibberella zeae PH-1
atggcagccgtaacagccaacggcgatgccgccgcatccgttcttgacgacatcaagcctcccgctggcgtcgtccttcctcctcgcgagattcgaaatgtccttgagaaaactgccggctacgtagcgcgcaacggcgccgtcttcgaggatcgtattcgcgacaaggaacgttccaacccaaagtttagctttcttaacccttccgatgcctatcaccccttctatcaatggcgacttgatgaagtgaagaatggacgtggcacagcaattgctgctggccgtgcgaatgaacctgccgctgaacctcccaagccccagggacctccgaaacccgtcgattttcaattctctgcgcgaacgcctcgcatcgcccgaaaagatttggatgtaattcaacttgccgccttatttgttgctaaaaacggacggcaattcatgacacagctggctcagcgagaagctggcaacccgcagttttcgttccttattcccaaccatactctccacaactttttccagcatatcgttgatcagtatacaacacttttgcgcgcgagcggtctgagtggagaaggtggaaagcttcaagaagagcgtgtaagagaacttgaagccaacatcaaggataagttccttgttcttaaccgcgccaggcaacgagccgaatatgccaaattcgtcgagtccgaacgtcaaaagaaagaagaggaggaagaaaagcagaaggaggaatttgctcaaattgattggagcgactttgttgtcgttgaaaccatcactttcaacgaggccgatgaccatgccaacctcccccctccaaccaatctttccgatctccagtatgcatcgctcgaagaccgcaacaacgcatctatcagcgcgagctttcgaatcgaggaggccatgcccgacgaggataccagttacaacgcatatcccaaccagcccgtcgcttaccctattgctccccagcaaccagcctaccaaccggctcagatgcccccaccaatgcaaccttacgctcctcttccacaacaagcgcagcgatccgtccaggaggaggaagaagagcgacgtatccaggagcgcgcagagcagcaagcacgcaagcagcaggctactgccgaagcgcgcggcggtgctcctcctatgaaaatcaaggagaactacgttccacgtgcggcacaaaaggctgctaacagacaaggtgctcagatggctctttgccccaactgcaagcagcaaatccctatgaacgagctcgatgcccatatgcgaattgagcttctcgatcctagttggaaagagcagaaggccaaggcagactcgcgctatgcttcgaccagcatatcccatgtcgacgttgcaaacaatctaaagcgtcttgccagccagcgcagcgacgtctttgaccctgtgactgggcaggcaatttccgaggacgagctggcgcgtagaaagaaggctgctatacacagctacgatggtgccatggacgctaagagccaagcacaactgggacacatgcaaaacgttaacgttgaggaccagatccgtgccatacaccaaaagttcgctgacaaaaagtga

SEQ ID NO: 208 - DNA, 912 bp, Candida albicans
atgggtactttgttgatttctaaaattagagaagaattccctgatagaatgatggccactttttctgttgtcccatcaccaaaagtttccgataccgttattgaaccatataacgctactttatcagtccatcaattggttgaaaactctgatgaaactttctgtattgataatgaagccttgtacaatatttgtcaaaacactttgaaattaccacaaccatcttatgctgaattgaacaatttggtttcttctgtcatgtctggtgttactacttctttacgttatccaggtcaattgaattccgatttaagaaaattggcagtcaatttggttccattcccaagattacatttctttatggttggttatgctccattgacttctatgggttctaaatctttcagatcagtcaccgtcccagaattgactcaacaaatgtttgatgccaaaaatatgatggctgcttctgatccaagaaatggtcgttatttaactgttgctgcctttttcagaggtaaagtatctgttaaagaagttgacgatgaaatgcacaaaatccaaaccagaaactcatcttattttgttgattggattccaaataatgttcaaactgctgtttgttcagttcctccaaaagatttggatatgtctgctacttttattggaaactctacttccattcaagaattatttaaaagagttggtgatcaattcagtgctatgttcagaagaaaagctttcttgcattggtatacttctgaaggtatggatgaaatggaatttactgaagctgaatctaatatgaatgatttggttagtgaataccaacaataccaagaagctagtattgatgaagaagaattagaatatgccgatgaaatcccattagaagatgccgccatggaataa

SEQ ID NO: 209 - DNA, 3010 bp, Cryptococcus neoformans var.
ccataatgaacgctgcccagcttctccaggactccctttcctccaaccaggccgcccgagaatccgccacccagcagctcgaggccgccgcgagggacaattttcacggctatctccacacccttgccacagagctcgccaacgaaagccagggcctcgatgtaagatatgccgcaggtctcgccttcaagaacggtatcgccgcccgggacgctataaaccagcccgtgctttccgaacgatggcttgccctccccgaatcagcaaccaaccctctcaaacacctttcactttccacccttgggtctccccagcttcgtgccggtgcggtcgctgcgcagtgtgtttcagccatcgctgcaatcgaattgccggtgggcaagtggccagagttgatccctcagttactcgaatttgtgcagaaccaggacaacactggattgagagtcaacactttgcaggctgttggctacatctgtgaagtcatccgacctgatatccttgctgccaagtcaaatgagatcctcaccgcggttgttcagggagcccgaaaagaagagcctagtcacgaggttcaacatgccgctattcaggccttgtacaattctctcgagttcattagggataacttcgagcgagagggcgaacgaaactacatcatgcaggttgtatgcgaggctactcaaagcccctctgttcctgtccaagtcggagctttcgaatgtctcgtgcagattatgcacttgtactacgaaaagatggacttctatatggagcgcgccctctttggccttaccatcatgggtatgaaacatgccgaggaacccgttgctctccaagccatcgagttctggagtactgtctgtgaagaggaaatcgagttgactgctcaggcccaagacgctttgcaatacggcgatcaccctgaaattgagtccaagggttttgccaaggctgctctcaatgatatccttcccgttctcctcgaactcctttctcaacaaaatgaggatgatgacgaagatgactggacaaagtctatggccgctgctgcctgtctgcagcttttggctcagaatattggtgatgagattgttgggcccgtcgtgcccttcgttgaggccggtatcacccgacaagactggcagcaccgagaggctgctgtcatggcctttggttccattcttgacggtcctgaccccatgactctcgctcccctcgttacccaggccctcggtgctcttatcagcatgatgcaatccgacccaagcttgcaggtccgagacactgttgcttggacactgagcaagatcaccgagaccatgctcgaggtcattgaccctagtattcacctccgcaactttatcacagcccttgtcatgggcctcaacgcctctcctcgaacttgcaacagttgctgtgctgccctcaacaaccttgttatgcaaatctctcaaccccctgagctcctcaccgaagaggttcaaactactgtcatgtctgaatactactctggtattctcaaggagttgatgcccattgcagagcgacccagcaaccagtccaacagccgaagcgctgctgttcagactatcgctaccttcctctccttttctgccaacgacactctccccgtcgttcaggaggtcgctgttgccttcatcgctcgtcaggaagcccttatgggtatgcacaaccagcttgttggtatggatgaccgaaacaactggaatgacatgcaaatcaacaactgtgttgccattgccgccttcatccggcgatcacctgctttggccgctcctttcgcggacaggatcatgaccaacctcatacagctcatttccgcctctggcaagcagtctggtgtgctcgaagaagcgttctccaccattggtggtcttgcctctgcccttgaggccggattcaacaagtacatggaggcctttgccccttacatcatcactgcgcttggatctcacgaagactattctgtcgcccaggctggtgtctttatcacttctgacattgcccgatccgtcaacgaaggcctccagccttacgccgagtctctcatgtcctcactcatcgagctccttcgatcgcccattgttgccagacaggttaagcctcacgctatctccgccatcggtgaagtggctcttgctatcggatcgggcttcaagcccttcctcgaagccaccatggctatcctttctcaagctggatccacttctgctccccctggtgatgaggctatgatggactttgtgcagactatgagggagtctattgttgatgccttcattggtatcatgaacggtttcaaggactccgaggccggtgtcatgctcccctacgcccctggtattctttctttccttcaaacttgttgggccgacgaggaccgttccgaaggcttctgcagtgcctcccttggtctcattggtgactttgccagcgcattcaagaacaacatcaaggaccaaattacacaaaactggattcaagaggctatcaccagcggcagaagcagaagcgcttccaagcaatccaagaccaacgccgcctatgctcagcacgccatcaaggaactgctcaagtaaattgattcccactctccctcgcccgatttatcgtctcgcatgatctccccacatatcatctcttttgcatggctctcacgaacaaaaacgctcccatatttcattcacaagtataaagtatctttgccgcgctctgtcgtccgaggacgttcaaccgccgccattatttgcatcaatcacatggtcctagaagaatgactctttgcattatcattttaatttttctcccgtttctcatatattttatttctttttttcattcaaaattttggcgagaggcgatagacttgaagaagcagcagttcgaaggtcgttgttgaatgtgttggattcatcaaaagtgtagttttcttttatcatctttctgcctttgggctttctagttccctactagtgtgtgattagga

SEQ ID NO: 210 - DNA, 852 bp, Gibberella zeae PH-1
atgaattcccttgtctcgcaatacagccggtcctcgtacgagcagaacgagcctctcgacgagcaggatgagctcctgaactctatgggtggtgatctctcgatcaagtttgccatgcctcccgttgctcagccctcatcatggctccgcgctgccacagatgaccgatccaaccccaactgccccatcaagatcgctcacggaaccaccaccctcgccttccgcttccagggcggtatcatcgtcgctaccgactctcgagccacagccggcaactggatcgcctcgcaaaccgtcaagaaggtcattgagatcaacagcgtcctgctgggaaccatggctggtggtgctgcagactgccagtactggctcgcctggctcggcatgcagtgccgcctccacgagctccgacacaagcgccgcatcagcgttgccgcagccagcaagatcctcgccaacctcgtctacagctacaagggtatgggcctcagcatgggcaccatgtgcgctggtgttaccaaggaagagggtcctgccctttactacgtcgacagcgatggcactcgcctggcaggcaacctcttctgtgttggatcaggtcagacattcgcctatggtgtgctcgacgccgagtacaagtacgaactatcagacgaggaggcccttgagcttggaaagcgaagtattttggccgccacccaccgagatgcttactctggtggttacattaacctgtaccatgtcaaggaggagggctgggtgaagcacggcttcaacgataccaaccccatcttctggaagacaaagctggaaaagggcgagttcaccaacgtgacaagcaagttgacttag

SEQ ID NO: 211 - DNA, 702 bp, Magnaporthe grisae 70-15
atgggtagcctgatcggatcattttcctgggtcagccccaccaaagttgttccggcaggcggtagcggagcttcgcagaacacactcaatatggaggttcttttggggatcacgggcaaggacttcaccttgatcgcagcatccaaggctgcgatgcggggagccaccgttcttaaggcatctgacgacaagacgaggccactcaacaagcacaccatgattgcattttcgggcgagcctggagacaccatccagtttgcggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctcagtactactgcctctccatcctcgacaaacatcaccatcccgatatcaccctgcaccagggtatcaagatcctgactatgtgcaccgacgagctgaagaggagattaccgattgacttcaaaggaatggtggtgaaggcggtgacaaaggatggaatccgagacatcgaatttgatgatgacaagattgtcaagagtgcttga

SEQ ID NO: 212 - DNA, 4272 bp, Aspergillus fumigatus
atgttttcaccgcttgcatttccaactgggatgataatatatgaccttacattttccgtccctcccatatcacatttagagttgttcccattcgaaatcttccgagaacctttggttgtcatagctatagcggatggagccgagttacctgaagaaaatgaggagagtgaggcagattcagccacaaggtccggcgatcgaatgcaacccgggctagacgaactgttggacggactgcgcttgcttaaggagaaaaacactcgggcgctagttcaccagctcttgatctttgatcgtgagggcgtgagcaagctttcgagtggtcccgacggtatcatatggattccccgacctgaagcgtccaaggcgacgacgataaaaactgcgttgtgcgacatcacgtcgatactgctttctgaacttgacgagttcgcgaagacgattcaaagcgttccatttattgaatctcccaaggcctcatcttgggggccacatcgtggcccagacttgcgcacaaggcctgccgacaagctgattcaccggatgacactgcctacgcatctcccatcccaccctaatgatgcaccagagacttctttggcttccaacaagagctcgcctggtccgagtgagcatgaaacacctacgacctttgacgaaattacacggtctatccagctggctaaccgcgcaagtacctttggcaagcccaactctctaccgacctcgaaagagcatagtcgtgatcgaatgtcagtgagcggaatgagtgctactgatcgcacgaaaaaccggatcaaaggccgtacgggagtagtgattgggaccctctttcttcagacgggaagatggccagacgctcttaaagaattggtagaagcagcgacaaatgccagggctagcagtgattatgtgtggcatgccaaagctctcgagtcaatccttctttgtcttctcatgttcgcatgggcaggcatggatttccaggtacccccggtctgctacccggtcgccgacaaatcctctaaagcaatccaaagcagtgctcttgaagtgggacagtctacgccagggaaccgcatcatctcccttcaaaatctcgctaaccttttacccgaccttgcgaacaatatccttcatctctacgatcgtgcttctaatattacagatgagccggtgcctcagcttgtcttttcggagacagtaatccggctctcaagattgctggtagccgcgcgaatccgggatggcgctctggacgataatgctttgaagcacatcgtaatgaacgagcctttgctgccactgcatcggcccgaacgtcctcgtggcttgatcatcctccgccagtcagagattgcgaatttcctgttccgtgctttgccactctcccctagctcaggtctgcctgcaacagatacaataccgattatcattggagtcgtgtctgtactgaatgcgcttgatctaccgcggaagaaagcgttcattttgcgggaatttctttcgataatagtcccaactctcgtccaggctcgcaaaatcggtgctgccgaagtcgggattcaccccgccgccgggttggcgtcgctcagtgatacggcatttgatattaacgcgcttgatgttggatcagggaatatggaaagcagcatgcgtgcccttttgggtctcataggggaaatatatggtgtacaaccatctccattctatgagtgggagaagaaacgctcctcgactgcaagtgggacggatccaatccctgagtatgattctatcgcggccattattgagcggtcatttcgccatgtggcccttgacagatatggcgacctgaatttgaaaatagacgctctcaaagcgtgcatcaactgctgcgaggcgcttcctgatttcactggtgttctccagttcacagttgaactgctccaaaccattcggggagacctgatgcttgctgaaaattattatcagcctccgttcctgccgcaagacgagcaagttcgcctattgaacaatattaaacgaacagtgagcgctgcccataagcttggcgcttcagacctagaagcagaatactgggatgacttcctcgtgcgtgacgtacggctccttgccctacctgactctaagcgacctgttcgacgttccaagtcacaccttgaagtggtctcaggcaacggcgacaagccctcaaaagacccgttcttgtacaacccattttctaagacaagcagtaaaatctcggagtcgctcatgatcgccggtgagcatgcagcattcacagttactcttcaaaatccttatgagttcgaaattgagatcgagcggattcgtctgcatggtgaaggtgtgccattagatgctgttacagagtggataacacttccaccgctttgcctacaagaagtgacggttatcggaactgcgcctacagaagggacagttaatatcaccggttgtattgttaaagtgcgatattgcagggaacgcaaattcccgattttcaaggatctctggaaaccagagattgaaatgaagttcaagcgaacaggtctcgcggccaaaagacctttgacagatcgacccctgtcgtggagctcaactacttcgaaagatgggaaacaacagccgaagaaaggcccccagacgacgtcctgtgaaatcaaagtcattggccaacagccggacctcgtgattgagtcgatgtcattgtcgcaatccgcggtgatggtgctggaaggagaaacccagtccttcgacatcacactgcgtaacgcgtcgagttgcccgcttgacttcataacttttacgttccatgattccactacaagacagatccagtccgcgttgacaaacaaagacctgctgccggtagaagtgtacgagttggagcttcaattatctatgaaaccaggcctgcgatggcgccgacagggttcctcaccagacaaccttgtcattgatgcgggacaaagtgcgacgttttctctcgatatcgttggcaagccgggcttgcaagagacgactgtgcaaattgattattcctatattgggctctccaacggccaattaccggaggagttctacacgcggcagttgttcgtaccgcttaccgtgacggtgaatgctagcattgaagtggctcgttgcgacattttaccttttagcagtgactttgcatggcggaacagccaggaatcggagctggattctgtcgggaacagctccacggacggcgacccatttgccccagtgctatctcaactgggacgaggcgcatacgggcacgaccactgcatcttgctacttgatttacgaaacgcctggccgaatcctttgtcagtcactttacaagtgagcgagcaaccaatagaagagagttctgcggaggaattcactcccaaggttggacagtacaccctcacgggagagcttcagccgggccagatctcgcgctttgttcttgtcctcccttgtgtctatgtagacaatccacatgctccgataccggttctgaatactggaatcaagaggcagtttgtcgtgagtgcaaacaagctcacttttgaggcagaagccgcgtcacgggaggctttctggttccgggaggaattgctcaaaagactctcaggcgtctggaaagagagcacaacgacttctggccacaagggagtaattgagctaagaggcatacgaatgaacgcgcggatggtggacgcctttcgactcgacgccatggatatcagcttttcccttagcccctcctttccgaaacagaaggcatcctccgctgaaagcattgatgaagtgatgcagatagggcggtcaaaatataaggtgcagaccgacgagatgcttgatctcactgttaccgttcggaaccgctcctcgaagccaatccacccacttctccggctccaacccagtcttcgccaccaacccagtaatgttgctcttgatctttcgaagaggctggcatggactggcatgttgcagcaagtgctgcctatcttgcccagtggagagagcactagtgttaccatcggagttaccatcttctgccacggagagtacgaagtcggtgcaagtgttgaagaagtgcgaaccctgagatcgacagttggattggagaaggatcacaagccagcgtacgatgcgcccgtactacacgatgatgaggccatcagagactcgtttggattagacgctactcgacgaagacggatctggcatgctagagagacatgtatcatgcatgctactgattaa

SEQ ID NO: 213 - DNA, 4869 bp, Aspergillus fumigatus
atggaagacggagataccctggttggccttcggggcctgtaccaggatctgtctgctctttcagactcgtcatttgtcaacattgaacgacttcgtgttgagttggaaactcacattgaggatttcaagaaactcttagacaaaccctcgaagaacaacacaagtcggcaggctgttctctcagggaagattaccgttgacgatgtcgaatattcaatcaaccaagactttcaacaaggcgcactacagcttgcggatgctctcaacattgatgaactggaggccgctgttctattctttgcggcgcaggaggaagctcaagtactggatagacctccgctgatcgcggcaattatgcgctttcatgaacggcggcacttccttcttgaatgcttacgcctgattcttcaagaatcgtttgaggttgagcgggaagtgacgcaagctctcatgcaagatatggtggcattcatcgtggagatcaaaactggacccttacggaatgcatcgctttttgcgcggaagtgcatgaagtctatggaggatatcgagggatggttgctgctccttggggagcagattcaaaaggcatccattgtcggccaggtggaggatcgcgatgttatggaagccattgaataccaacgcagcagcctgcagcaacaacacgagtcattaggcgcaattctgtgctatttcttcaaaggaccttataccagccctgaggaccttcgggtgctcctgaatcgcttaaggaagctcgaaagatttgatggactgctgcttcactacatccctgctatgatatcgtcgtttgtccagcacggctcaccagaacggtcgaattcatacaaagaggccaggagcctgcacttggcggtcacctctaccaaagatggccaaacttggacgatcccgacgtttcacgcagctgtcatcgcgctttggcttgcggtttacagtggctgggatatcgatgggccgacctctcctgtccaaggggtcgacttcgaaaaagaagcagaggagcgaactcaaatgttcatgacggcactcgacgacggaggactcgatttcttacttgctatctgctcaggtgtgaacaacgaagagtgggctgacccggctcgccgtgaattagtggcgctattgttgaaagaaagcgcattcgcgaatttggaatccgaaccctgtgctggatttttaaagactctactgatggagaacctagagatttttgtggagtcttgcattgccaacatgccagatgcagttcgaaagctgaaatccgaggaggatatgcaacgcttggatcagattactgccttgagggatggtttgtcgtccagcctccatcgcggcctggtcgaagctcgcactcatctcgagtctttcctcatgatcatagcattcgcattcgaaagccgaccagacgcagctcaggagttctgggcggacccagacggcaatttgtatggtttccttcaatgggcttccaaaagacagactgttccgagagtcagcgccttttgcgagttgctgtgttctatttctggcggagaggagaatgccgctgctgcacatcgatttctaaccgaggaggacaagttcttgtcgtccaagttcaagcgatccacttccatgaattggtcccagatgtttgctgaactccaattgtacgcgacgagggttactgagaagcctagcgcttcccaagcggtcctgagggctcgaaagtctgaacctgccgacatgagcgagccagaaagccctgtcatgctgacttgctatctgcgattaatgggtcatttatgcaagcagagtggctccataagggaatggatgcttcagcacccatctttcagcgttgttagcaccttgttgaccttgtgcagcggccccatacccacccacctgagggccactgttttcactacccttgcagctttaatgacggacagaacgtcccacaatggcaacgagatgtggctctctcttgaccaatggatttccgggggcgccatgagtggccccggccttggtaaagtgcccatagtgtcaaatccattggtgtggcacgagcagcaggcattccagaagatcggcgagagttttgatcaggccaatgcctttgtcgtcttgatttactcgctcatcacccctacctctgactccacagagtaccatctgtccctgcccttccccgaatctctaggatcctcctatcgcatgccaggtatcgagccgtacatcgattttgtcatgggtcaggccctctcgaggaaagttccagatctgggcgagcgccaaactcgccttctgacctataactgcttgagtttcgtcatcacgtgcttgagatcgttcaacgagaacattgtaactgtcctcagccaacccacaatcagctccgattcttccctgaaaacgtcatccttgaccacctatatccgtcttcacccgtttgcgcgtgtggctgagtggctattcaatgaagatgttatcaaggcgatcttcgcaacagctcagcaagacgccagcgaggttgccaacgccgcgtctgactctatacttattcagtgcttggtcaaaagcatagaagtcatggacctgatgctggatctgcaatcgacctacttccatatcgtccggccgtccatcaagtctcaggcaggtggaagcagaatcaacgtcgctaattcgtcgctttcatccttcgaggatagcatcctcaacaacttaacgattatacctgctctgagcctttattgcggcgcgggtcacgagcaacttaccgttacctcaatggcacttctggagaaaatgtcaagctctaggaagttgaacaagttgtcgtcaccagaaatatcgaattggcaatcctcaaacaaaatagttgaagtcctgagcacagaagtggacgttgacagtgtttcacggccgctggtgtctcagatgcaacctgaattgagggagttggaacttggtgcacggtccccaggctatattattagggaaagccttttggcactcctaaatagctgtctcagcatgatcacggatcggccgactattgctcatcttttcctcgggttcagtagcgtgggaaccatgctggatatttctccgaatagtctgttctcaaacggaatgtccttgttacatgctatcattgggttcttgcagagctaccctgatgcgatggaagggaacattcttccttggatggtacatctacggcgtatggcccttgaagttctcaaacatctatggtcctccaagatcgcgtctgcgttcactctgcttgagatgcgttccagccgctttctactcagcatgtttgccagccaacctataatcggaccagacactccttttgatgggttatctgtcatggacgaagaattctggatctctgagtccacatcagctcttgctgagttcttactttttagaagttacttgtatgcctacgcggcgaccgaaattcgcgcggccgccaagctcggctcgcagacacttcagacagagatcctttcgacgttgcttgggaactcaaccacagagacgggggagacaatcctcaatcccaccgtctttgatctctttgattttgctgacttggatctcagccacaagattccagcgcccagattagtcttccttgatgggattggctttgatgtgtgtgcgaaatcgcaagcagacgagtcgcttgttctgtacaatctagcggaggttgcagagctcatccaagtcagaaaggaagagttgctgtcgagtgggcagttgcgacctcaggatgaagagcaattctcggccgaagctgaaggcctgacgttattcattcgtgcgacaaatcaagcaaggcaaattgcgtttaaccgttacctggctcttcgatcatggacagagctcatcacaacgatgctggcttgttctgagattgagggtggccgaaaaccaacatttatcttgcattcaatccagttggtcctccctaaactcgaagcagccatcgaggaggacctaccggaggcaatcgagcttgcacgactcgccgagactcttatcgggggtctcgaatttacgtccacgagtacagacggtgcacggcgaagtggggatatcatagacgaaaaactgcaccagctgttccagatctgcattagaggtatcttcctggcaagtggaaatgttcagttgcgtgagacgttttacaacatcggttcccagtacatcagtcgtatcgcctccgccgatacggtgaatcagaatctgaggcaccacagtcaacaagtgataaagacagcgggatctaccctgattgagaccacctgtgacgacgcatacgccgggcaagaagcatgtcgggtgtcggctctgctatttctcaatctgctggccactctggatcgagaaacagactcaactctggcagagttgatctcacaatcgaattatctcagtcttttcttggacgccatcagagcgctacctcacgaactgaagaacactcaagcaaatgatattgacaaccctgatgctcttcggaaatattatgatcttcttggctcggtactccgggtcattatctcagctgtcttctctcggggtcttcataatgagcaaatcatgcagcaaacacgagctttcttggcagaaaacagacagagcatggtcggcatcttcaagcgatttgctaagatcggtggagtaggtactgctgatcatcacgacgcgctgagtgatttggccaagtgctacatgacgctcatcagcgccaccaacttcctagaggtatgtagtcaagccgccataataactgcggatgctaatagagaacccagtacgaggacgaggaagtga

SEQ ID NO: 214 - DNA, 891 bp, Aspergillus fumigatus
atggataaattagtcgcccagtactcgcgtccacctcaccagaatgagttctactcagagcaagaacagcaagacctgacggagagcctccctcctttgtctctgaagttcgctcttcctccagttgcaaattcctctgcattccttcgtgccatgaccgatgaccactcgaatcctagctgtcccatcaagctcgctcacggaacaacaacactcgccttccgatttcagggcggaattatcgtcgcgacggattcgagagctaccgctggaaactggatcgccagtcagacagtgaagaaggtcattcccgtgtcgcggttgagtcggggtgaggacaagaagcaggatactccggttcctggtctattgggtaccatggctggtggtgctgcggattgccaatactggctgagatatctgagccagcaatgcacacttcacgagatccggcacaagcgtcgtatcaccgttgctgcggcatcaaagattctcgccaatctgacatacgcctacaagggaatgggtctcagcatgggtacgatgttggcaggcatgacccctcaagaaggaccggccctctactacatcgactcggacggcacaagactctcaggaaacctgttctgcgttgggtccggtcagaccttcgcttacggtgtgcttgacgcagagtaccgctacgacttaactgaagaggaggccctcgagcttggttgtcggagcattcttgccgcaatgcaccgtgatgcttactcaggtggtttcatcaacttgtaccatgtcaaagaggaaggctgggtccaccacggtttcgacgatatgaaccccattttctggaaaacaaagctggaaaagggcgagttctcgaacgttacgtcggccctttaa

SEQ ID NO: 215 - DNA, 636 bp, Botryotinia fuckeliana
gcgaggagttcccagatcgtatgatggctaccttctccgtcgtcccatcgccaaaggtttccgataccgttgtcgagccatataacgcaactctctctgtccatcaattggttgagaactctgacgagaccttctgtatcgataacgaggctctttacgatatttgcatgagaaccttgaagctcagcaacccatcttacggagatcttaaccacttggtttccgccgtcatgtccggtgttaccacctgtctccgtttccctggtcaacttaactcagatctccgaaagttggctgttaacatggttccattcccccgtctccatttcttcatggttggatttgctcctttgaccagtcgtggcgcacactctttccgtgctgtcaccgttccagagttgactcaacaaatgtacgaccctaagaacatgatggccgcttccgatttccgtaacggtcgttacttgacatgctctgccattttccgtggtaaggtttccatgaaggaggttgaggaccaaatgcgcaacgtccaaaacaagaactcatcctacttcgttgagtggatccctaacaacgtccaaaccgccctttgctccattcctccccgtggtctcaagatgtcctccaccttcg

SEQ ID NO: 216 - DNA, 861 bp, Paracoccidioides brasiliensis
  misc_feature (1)..(1): n is a, c, g, or t
ntcggcacgaggaccttctgtatcgataacgaggctctgtatgatatctgcatgcggactctcaagctctctgagccatcatatggcgacctcaaccatcttgtctccgcagtcatgtccggtgtgaccacctgcctacgattccctggtcagcttaactctgacctacgcaaactcgccgtcaacatggttcctttccctcgtcttcacttcttcatggtcggattcgctcctctcaccagccgtggcgcatactctttccgtgctgtcaccgttccggaattgtctcaacagatgttcgatcctaagaacatgatggctgcttccgacttccgtaacggccgttacctcacctgctcagctatcttccgtggtaaggtatccatgaaggaagtcgaagatcagatgcgcaatgttcaaaacaagaacaacacctacttcgttgagtggattcccaacaatgttcagaccgctctctgctccattcctcctcgcggtctcaagatgtcttccactttcgttggaaactccacctccatccaggaactcttcaagcgtgttggtgatcagttcaccgctatgttcagacgcaaggctttcttgcattggtatacgggtgagggaatggacgagattgaattcactgagggcgagagcacatgaacgatttggtcccgagtaccagcagtaccaggaggcttgccttccccgaggagaggctgactttgtcccggaaaagtctggaggcgagagatcagagaagttagccgttatttcttgcccttctttaaccgtttcggcgccttgccccgtgtgggtttttcccctctaggttccccctggctggtggtttttgtttgc

SEQ ID NO: 217 - DNA, 1168 bp, Phaeosphaeria nodorum
tttgactgtagggcgattgggtaccgggccccccctcgagttttttttttttttttttgggaatattatcaaatctttgcattaacaagagttgctttacgcttgaaggtacgcctactgcttgtatgatagcgctttatggcagcaacaattgcctctgccatactcgcttgccatcaacacagtcatattcataccaattgccaacaaccaagcacagcgggtattatgggattaacagccagtttactcctcagcctcgagaggagcctcctcgtcgtactcctcctcccctcggaatggaggcctcctggtactgctggtattccgacaccaagtcgttcatgttggactcagcctcagtgaactccatctcgtccataccctcaccagtgtaccaatgcaagaaagccttgcgcctgaacatggcagtgaactggtcaccgatacgcttgaagagctcctggatggaggtcgagttaccgacgaaggtggcggacatcttgagaccacgcgggggcacggacagaagcggtctggacgttgttggggatccactcaacgaagtaggacgagttcttgttctggacgttgcgcatctggtcctcgacctccttcatggagacctttccacggaagtaggcggagcaggtcaggtagcgaccgttgcggaagtcagaggcagccatcatgttcttggggtcgaacatctgctgagtgagctcagggacggtgacagcacggaaggagtgcgcgccacggctggtcagaggagcgaaaccgaccatgaagaagtggagacgggggaagggcaccatgttgacggccaacttcctcaggtcagagttgagctgaccggggaaacgcaggcaggtggtgacacccgacatgacggcggaaaccacgtggcttcagtccgtatgaggggttgttcagcttgaggtcctcatgcaaatgtcgtaaaagcctcgttgtcgatacagaatgtctcgtcagagttctcgaccagctggtggatggaaaggtggcgtgtaaggctcgacaacgtgtcagacttggggatgcacaacggaaagtgtcatcatgcgtcaggaatcctcccggatcttggaaatcaaagcgtaccaatactagcatcggaaccaccaccgaaaaaaaaagtgggggt

SEQ ID NO: 218 - DNA, 1821 bp, Gibberella zeae PH-1
atgacgtcgatcgccgggtcgctacaggctgcgctgccaaagcccagatacacgggcgaggaggaagaagcccccgcgcgagcgcaacaacgcggtgttcggattgttggccctggccagctcgacgaaacgcaggtcgtcctcaaacgatctggccctccagcatacggccagcgcgtaggatggcgaccacgatcgcaagaagactttggagatggaggtgctttcccagagatcccgatcgctcaataccctttggagatgggaaagaaaggcgccaactccagcaacgcgttggcgattcaggttgactccgaaggcaaggttaaatacgatgccatcgcgcgacaaggccataccgagaaccgaattatccatacatctttcaaggatctgattcctcttcgacaacgcgccgatgccggcgagatcgatctttcgcgaccagacaaggagtctgtggaggcaacaacagagaggacgaagaacgcactggctgcccttgtcagtggtgcggtggcagctcagaaaccgaagaatgtcaatattggacagcgaaaagatcctacttttgttcgatatacgccagcaaaccaaatgggcgacaactctaagaagcaagatcgtatcatgaagattgtcgagcgacagcgcgaccctatggaacctccgaaattcaagcacaagaagatccctcgaggacccccttcgccacctccgccagtcatgcactcaccaccccgaaaactcacagccgaagacaacgaaatgtggaggattcctcccccagtttcaaactggaagaatcccaagggttttacagtgccattggataagcgtttggctgcagatggacgtggattgcaggatctggccatcagtgacaaacatgctcagttcgctgaagctgtcaagatggctgagcgtcatgctcgtgaagaggttcaacagcgtgctatgatgcaacagcgtctagcagagaaggagaaggcacagaaggaggacaaccttcgagagttggcccagaaggctcgtgctgagcgatctgctgctggccgcgggcgtagggattctcgcggttcccacgattcaagggactccagagactcgaggtcacgatcgcgaagttatagttattccgagtcagaccgctccgacagcgaggacgaggaagtcagagagcgtgtcaaggctcgccaggagaagcaaagagatgaggagcgaaagctacgacagaaccgcatgggtgctgagcgacgagctcaggtcatggcccgtgaacaaggccgagatatttcagaaaagattgctctgggtgtggccaagcctacacaatcaaaggagaccatgtacgactcgcggttattcaaccaaacaagtggatttgatagcggcatcaacgaggacaacccctatgacaagcctctctttgcggcacaagacgccatgaacagcatttaccgcccacgggtaaatgtagacgatgatgacgatgcagaggcgggtgaccgagagatggcaaagattcagaagagtagccgatttggcgaggctcttggaaagggaacatttaagggtgctgcagatgccgaggtaagctcttcattttttttattctcatctacacattcactaacactttttacacaggcacgcgaaggtcccgttcagtttgagaaggatgctggagatccttttaatgtagacaagttcttgtcagaggtggatcagaactcctctaagcgtggttatggcttgcaagacgatgatagcaggcagtccaagcggccgagagttgaccctgacgacgatgaagaataa

SEQ ID NO: 219 - DNA, 633 bp, Aspergillus niger
tgagcactccgacgagaccttctgtatcgacaacgaggctctgtacgacatctgcatgcgcaccctcaagctctccaacccctcttacggtgacctgaaccacctggtctctgccgtcatgtccggtgtgaccacttgcctccgtttccctggtcagctcaactccgaccttcgcaagctggctgtcaacatggttcccttccctcgtctccacttcttcatggtcggcttcgctcctctgaccagccgcggcgcctactccttccgtgccgtctccgttcccgagttgacccagcagatgttcgatcccaagaacatgatggctgcctctgacttccgcaacggccgctacctcacctgctccgccatcttccgtggacgtgtctccatgaaggaggttgaggatcagatgcgcaacatccagagcaagaaccagacctacttcgtcgagtggatccccaacaacatccagaccgccctgtgctccattcctccccgtggtctcaagatgtcctccaccttcatcggtaactccacctccatccaggagctgttcaagcgtgtcggtgatcagttcactgctatgttccgtcgcaaggctttcttgcactggtacactggtgagggtatgga

SEQ ID NO: 220 - DNA, 720 bp, Botryotinia fuckeliana
tgcaagatatttatactacttgggacgaatcagggccattcaattgagatacactgaggcccatgaacatttgacagccgcaactcgcaaagctccttcaagtccgagtgctgcaggattctcacaaactgcgacgaagttacttcttgtggttgagttgttgatgggagatattcctgaccgtgcaacattcagaattgctagtctcgagcgtgctttacaaccctatcttaacctcgttcaagcagttcgagtaggtttgattgcagaattcgaggctgtgattactcaacatgcagagactttcagacgtgatggcacttataccttgatccttcgtttacgacaaaacgtcattaaaactggtattcgaatgatgtccttgtcctactcaaggatctctcttcgagatatctgcatacgcctgaagcttaacagcgaggaatctgcggagtatatcgttgcaaaggcaattcgtgatggtgtcattgaggcaactttggatcgtgagaagggattcatgaagagtaaggaagttggagatgtttatgctactagggagcctggtgaagcattccatgatcgtattcgtgcttgtcttgctcttcatgatgagagtgttaaggctatgagattcccaatgaatcaacatcgattggaactcaagaatgctcaagaagcaagagaacgcgaacgcgaaatggcaaaggagattcaaga

SEQ ID NO: 221 - DNA, 555 bp, Magnaporthe grisae 70-15; identical to SEQ ID NO: 7

SEQ ID NO: 222 - DNA, 669 bp, Phytophthora parasitica
gcccctacggccagcttttccgcccggacaacttcgtgttcggacagacgggcgccggtaacaactgggccaagggacactacactgagggtgccgagcttattgactcggtgctcgacgtcgtccgtaaggaggccgagagctgtgattgccttcagggtttccagatcacgcactcgcttggtggtggtaccggttccggtatgggtacgcttcttatctcgaagattcgtgaggagtatcccgaccgtatcatgtgcacatactcggtgtgcccgtcgcccaaggtgtcggacacggttgtggagccctacaacgctacgctgtcggtgcaccagcttgttgagaacgccgatgaggtcatgtgtctggataacgaggccctgtacgacatttgcttccgtacgctgaagcttaccactcccacctacggtgacctgaaccacctcgtgtgtgccgccatgtctggtatcaccacgtgcctgcgattccccggtcagctgaactcggacctgcgtaagctggccgtgaacctgatcccgttcccgcgtctccacttctttatgattggtttcgccccgctgacgtcgcgtggctcgcagcagtaccgtgccctgacggtgcccgagctgacccagcagcagttcgacgccaagaacatgatgtgcg

SEQ ID NO: 223 - DNA, 891 bp, Phytophthora infestans
  misc_feature (619)..(619): n is a, c, g, or t
  misc_feature (648)..(648): n is a, c, g, or t
ccggtccggaattcccgggtcgaccacgcgtccgctgattctaagaaaatttctcccaaatttcaacaaaatgcgtgagattcttcatattcaaggtggacaatgcggcaaccaaatcggtgccaagttttgggaggttgtttgtgctgagcacggcattgattccaccggaagatatgacggggatgctgatcttcagcttgagagaatcaatgtctattataatgaagcttcttgtggtaggtttgttccgagggcggttcttatggatctggagcctggtaccatggatagtattagatctggtccttatggacagatcttccgtcctgataactttgtgtttggacaatctggtgcgggtaataattgggcgaaagggcattatactgaaggcgctgaattgattgatgctgttcttgatgttgttcgtaaggaagctgaaaactgtgattgccttcaagggtttcaagtttgccattcattgggtggaggaacaggatctggtatgggtacccttttgatttctaagatcagagaggagtacccagacagaatgatgcttacgttttcggttttcccttcacctaaggtttccgataccgtcgttgaaccttancatgctactctgtctgttcatcaattggntgaaaatgctgatgaatgtatggttcttgacaatgaggcgttatatgatatttgcttcagaccttgaagcttaccaccccagctttggagattttgatcatttgatatcagccacaatgtcttgtgttacctggtggttgccgttccctggtcagttgaactctgatctccggaggctggctgtgaatttgattccattcccaggctccatttcttagggtggggttttacctttgactcccg

SEQ ID NO: 224 - DNA, 669 bp, Phytophthora parasitica; identical to SEQ ID NO: 222

SEQ ID NO: 225 - DNA, 669 bp, Aspergillus nidulans FGSC A4; identical to SEQ ID NO: 222

SEQ ID NO: 226 - DNA, 3027 bp, Emericella nidulans
ctacgtgctccagattttgtgaggaggaaggcgagggttccgacaaagactatagggtcccttgctatatttgttgtttttctctttaactatactccgtgcttcttccccttctttgagatcttgcggtacagatacacttttttcggccatttgggactgaaagaaacgacgacagttgtttcctttacctttgtcaccatttctaacttcgtacgaggaagaggtagcttaggtttatcctgcctgatgctccctctcgactgacgattatttccttacccttcgatatccgatcaatactttaattttcgtcggcatccaataccctgcattggcctcgattccctcgactaatatgactccgtccacatcacatatttcgagccagctaaggcagctgatatattaccatcttgacaacaaccttgctcggaacgcgctgttccttgccggtcgtttacacgcctacgaacctcggacgtcggaagcttcgtacctattagctctgtgttacctacaaaatggtcaggtgaaagcagcatgggaaactagcaagcattttgggtcgaggggtgcgcatcttggatgttcttacgtctacgcgcaggcttgtcttgacctcgggaaatatacggacggtattaacgcgctagagcgaagtaagggacaatggacttcgcgaaaccactggaataaacacagtgagacgcgacgacaacacttgccggatgctgcggcagttttatgtttgcaaggaaaattatggcaggcacacaaggaacacaacaaggctgtggagtgttacgctgcagctttaaagctgaatcccttcatgtgggatgcattcttgaatctgtgcgaaactggtgttgatttgcgtgtttcaaacatatataagatgagcccggaattgtacagcatggtatcgtctgctgcgctcgaagatgttgaatcccaggttctacctccggacggtccactccagacacaagttaacccaaatccgagcttggacccgttcactgccggtacgactcgcagcgattcgacctctactcacgggagctcagctttgtgggaaaagttgaatggaagcacagttagtgtggcatcttcaggaacaggaccgcatcttccgcgggaaggcatggagactcctggtggccaaagtagcgaatctgatgatccacgtgtaaccaacggtaatggcacagatgtttttgagccgccgctagcccctgcaaagaagaatcgaacgatccaaacaataggcggcgatcatccgatggatcccccgccaaagatgcggccaaccggtattcgaccgaggacccgaaccaaattcgagtcagatgaaggtcatactgagagagacgcgggcatgggtcacaggttaggcgatcggaaacgaacggtctctggacaagttgcgcatccgtcggtaccgcattcaaccgaccaaggtgtcgggcaacggcgaagtgtacgtctctttaaccagataaagccatcaacgaacaaaatatctagcacggcattaggagtgaaagagggccgggaggtgaaaaaggtgagaactacggggaataaggcgcgcacaacaacaagctcaaatgtgggccgtgttgttagcggcaacaatcgacgacacgctggggagatccatgacggagacagcaaagaataccgtggaacatcttcaacatcaaatggctctcagaacgcatcgtctaagctcgctatatctgagcggaccaaatcggttgaagccttggcttggattttggacttgtttttcaagatagcctccggctatttctgtctcagccggtacaaatgctccgatgctatccagattttcagctctctatcccagggccaacgggagacaccgtgggttcttgctcaaattggacgagcttactacgagcaagcaatgtatacagaggccgagaaatactttgtccgggtgaaggccatggcgccttcccggttagaagatatggagatctactcgacggttctttggcatttgaagaatgatgtcgaacttgcttacctggcccatgagttaatggatgtcgatcgcttatcaccagaagcttggtgtgctgtcggtaactcgttctcacaccagcgggaccacgatcaagctctgaagtgcttcaagcgtgccactcaattggatcctcatttcgcgtatgggttcacgctacagggccatgagtatgttgccaacgaggaatatgacaaggcattggatgcctatagaagcggcatcaacgcggacagtcgacattataatgcctggtacgggctgggaacggtctacgataagatgggcaaacttgactttgctgaacagcacttccgtaatgcggccaagattaatccttctaatgctgttttaatatgctgcattggcttggtcttagagaagatgaacaatccgaagtcagcgttgatccagtacaacagggcctgcaccctcgcgcctcattctgttcttgctcgattccgaaaagcccgtgcgttgatgaaattgcaggatctcaagtcagcgcttacggagctgaaggttctgaaggacatggcgccggatgaggcaaacgttcattacctcctgggcaaactgtataagatgcttcgtgacaagggaaatgccattaagcacttcacaactgcattaaaccttgatcccaaggcggcgcagtacatcaaagatgcaatggaagcccttgacgacgatgaagaggatgaagaagatatggcgtgattcagtcctacttcttcacttccatcatatgttcccttccttgcttttgctcttgatcaccttgttctactcttggtccccagacagatacccctccgcgctggaatactctctactttgatgtatacaagagggtttacggattttttttttcactgagtcggatttatagcagcgacatcagcattacacgggcgttttccggtggattggttaaagcatgaatttgcattgcgttagctcgggcg

SEQ ID NO: 227 - DNA, 2430 bp, Aspergillus fumigatus
atgtcgccatcaatatcctacatttcaggccagcttaggcagctaatatactatcatctcgataacaatttgtgccgtaatgcgctgttcctcgccggtcgtttacatgcttacgagccccgaacggcggaagcgtcgtatttactcgctctctgccatcttcagaacgggcaagtcaaagccgcatacgattacagcaggaattttggatcgagaggcacccacctcggctgctcctatgtcttcgcgcaagcgtgcttggacctaggaaagtatctggaaggtatcacagcgttagagcggagtaaaggcctttgggcttcgaagaaccactggaataagcacagtgagacgcgaagacaacatctgccggatgcagccgcagtattctgcctgttaggtaaattatggcatgcgcataaggacatcaacaaagctgtggaatgctatgttgaatctctgaagctgaatcccttcatgtgggatgcgttccaagggttgtgcgacaccggagtcaatgtccgcgtgtcaaacatctacaagttgaattctgaattgctggccgtattgtcttcatcgccacaggcggatgctgagccaatatccgataagtctgcacacacgaatgggccactgcaagcgcaggcgaatgttaatccaagttccgatccttttgcctcgactacttctcgcagtgattcaggtaccagccatgggagctctgccttgtgggaaaaactaaatggaagcacagtaagcgtggcgtcatcgggagtgccagcatcaatcgtgcatgaaggagccgaaacgccgagtggtcaaagcagcggatctgatgagttccggttagctaacggaatgaacggcgcggatgcttcttgggaccctcctttagctcctgcaaggaaaaacagaacgatccaggcaataagcggcgagtatccaatggaccctcctcccaagatgaaacccactgggatccgaccaaggacaaggaccaggactgagccggaggaccaaatttcagcccagatagaccgggaggcaacaaatgcgcccagggtcggggaccgcaaacgaactgtttctggtcaggtagcgcatccaccgacgtcacaacccacagaaccaggagcaccccagcggcggagtgtgcgactcttcaaccagattaaacccacgaccagcaaattgtcggcgtccgcgctgggagtcaaggatgctagagaagtcaagaaagcgaaagccacaggtacgaaggggcgtacgacaaccaccaccatgggacgagtagtgagtggcagccgaaaacatgccagcgaacatcatgatgcagatggtaaagacggacggtcggtaccgtccgcccacactcacgccatctccaaaggcgctgctcaagaaagatcgaaagaaatcgaggcgttgacctggctgctggagctattctcgaaacttgcttctggattctttgccttgtgtcgctaccgatgcccagagtcaatccagatcttcaattcgctctctcaaggccaacgggaaacaccgtgggttctcgctcagattggacgagcgtactatgagcaggctatgtattccgaggcagaaaagtacttctaccgtgtgaagaccatggcaccctcgcgcttggaagacatggagatctactcgactgtcctttggcatctgaagaacgatgttgagttagcctatttggcgcatgagttgatggaaacagaccgcctgtcgccacaggcgtggtgcgccatcggtaattcgttttcccaccagcgagatcatgaccaggccttgaagtgctttaagcgggcaacccagctggatcctcagtttgcctacgggtttactcttcaagggcacgagtatgttgccaacgaagaatacgacaaggcgcttgatgcataccgtcacggtatcagcgcggatagtcggcattacaatgcttggtacggactgggcacggtttatgacaaaatgggcaaactggactttgccgaacaacacttccggaatgcggcaagcattaacccgaccaacgcagttttgatctgctgcattggattggtactggaaaaaatgaacaaccctaaagcggctctcgtgcaatatggtcgcgcttgttccttggcacctcattccgtactcgcgcgattccgcaaggcccgcgcattgatgaagctccaggagctcaaattagctctgtctgagttgaagattctcaaagacatggctccagacgaagctaacgtgcattatctgttgggtaagctctacaaaatgcttcacgacaaagccaatgccattaagcacttcacaactgctttgaacttggatccaaaggcagcacaatacatcaaggatgccatggaatctcttgacgatgacgaggaggatgatgaggacatgagctga

SEQ ID NO: 228 - DNA, 2736 bp, Ustilago maydis
atgcctccgttcgccaaacccgagaccgtcctgaaacggtccgaggaactcatcaatgtcggtcaacaccaggccgctttggccgcgctcaacgagattttcacctctcgtcgtttcaagcagactcctctccagtcgcttgaacccatcatgctccgatttgtcgatctttgcgttgatctcaaaaagggaaggatggccaaggaaggtctgatgcaatacaagaacgtctcgcaaaacacaaacgctcaatccatcgagctcgtcatcaagcactttatcaagctcgccgatgccaaagtcgtagaggctcagtccaaggccgatgccgccgttggtgaaattgacgtcgatgacctcgaggagtccgagacccccgagagcatgctccttggctcggtcagcgctgaccagaacaaggaccgcaccgatcgtgtcctcgtcacgccttggctcaagtttctctgggaggcctaccgtaccgcgctcgacattctccgcaacaatgctcgtctcgaggtgccctaccagcagatcgccaaccaggcactcaagttttgtcttcagtaccaacgcaaaaccgagttccgtcgtctctgcgaagtcctccgtcagcatctccaaaacgttgcccgctactctcaccacgcccacgccatcaacctcaccgaccaggacaccctccagcgtcacctcgacacccgctttgcgcagctcaactcggccgtcgaactcgaactctggcaagaggccttccgctccgtcgaggacatccacaacctcctcaccatggccaaaaaagctcctcgtcccgccatgatggccaactactacgagaagctcgcccgtatctttatggtctcggacaacaacctcttccatgccgctgcctggaaccgctactacgcccttgcacgctccatcgcaaagtccgagcaagaacacacccagatcgcctccctcttcactcggtcgttctcactcgcctctttccagcagctcagccaggtctacgacgccgtcaagctctccaaggtgatgcagctcgtctctgccttcaaagctcctcacagctacacgcccgccgaaatcgaaaagttctgcctcaacgcctgcaaaaagggtcacctcaacatccgcatcgaccacgttgcccaggccatcaccttccaggacgatgtcttctccaccgacgtccatcccgccgcttccgcctcgtccgaagctgacaacgttggtctgcaggcctccccctctgagctcgtgcgcacccagctcagccgactcgccacctgtctcgacaccacgctcaagaccatcgatcccaccatccttgccgatgcgcaggctgccaagcgtcacgtttttgcgcgcgccgtcgctgccgccgaagacgagcacaaggctgccattgcccgcaaggcgctcctcgcgcgtcgcaaggagctgctcgaggaaatggctacgcgcaaggagcgagaagaggcggccgcgcgtgccgaacgcgctcgtgctgccgccgaggccgaacagaagcgcatcgccgaagaacaaaagaagcgcgaacaggatcgccttaacaaggaagtcgaggcggtgcgcatcgaggaagccaagaaaatggcaaagtcgttgcaagagcgcggaggtctcaagctttccgaggaagaacttgccaatctggacacggacaaattggtccagatgcaggtagagcagatcgaaaaggaaaagaaggagcttgccgagcgtctgcgtctcatccaccgccgaatggaccacctcgagcgtgcctaccgtcgcgaagaggctcccttgctttcggctgactacgaacgacagaagcaggaagacctgcaatatcacaaggcggctcgcatcacgctgttgcagacttccaaggacaaacacgccgccgacctcgagatcaagaagcgtctcacccgaatcttgcccgactaccagcagcttcgttccattatcgaggataaacgtcgcggcgaatttgaagagcgaaggagaaaggctaccgagcagattgagctcgaaaaggaaaggcgtcgtcagcaagtgcgcgacgagaggagacgcgagcgacaagaggccgaagaggccgaacgtcgccgcgtccaagaggaacaagaggctcgtgctcgtgccgaggaggaggagcgcctcgccgagcagcgtcgtgtcgaagaggctcagcgcgccgagctcgaggccaagaagcgcgccgaaatcgaggagcgaagggccaagttccaggcgaccgccgacaagcaacgacagcgcgaggaggaggccgaggccaaccgtcgttctcgtgccgccggtactggtgctgcgcctgcacaagagttggccgctgctgatgctacatggcgccgtgctagtggcagccctgcacccactcaagccgagtcgcaacgtcctcccatctttggcgctgctcgtaccggtggcgctggaggctggcgtgagcgcttggctgccaaggaggccgctggtggcaatgctactgctgctccttctgctcctgctgccgctcctgcgcctgcctcttcgggagcctaccgacctggtatgttccgtgccgctgccggtgctggcgctgggggacggacggatcgcgtggcggccactcctctccctcccgctgccgcggctgccgagagcgacggctttaccgaggtcaagaagaacgtctaccgtcctcctggtcgtcgtgcctga

SEQ ID NO: 229 - DNA, 861 bp, Candida glabrata
atgcaggcgattgcggatagttttgggacaagtgcgcttgtcaaggagctgcagtacgatgaggaagggaacttgcacgatgacttcatagacgggaactacaacttctcgcagctggcacctgcgattgccatgccgccaattgcgtcgccgcaggcgttcctgcgtgcgcacacggacgactccaagaaccccgactgtaagatcaagatcgcgcacggtactacgacgctggccttccggttccaaggcgggatcgtggtcgcagtagactcgagggctactgcgggccagtgggtcgcctcgcagacggtcaagaaggtgatagagatcaacccgttcctgctgggtaccatggccggtggtgccgccgactgtcagttctgggagacgtggctgggctcgcagtgtaggctgcacgagctgaaggagaaagagcggatttccgtcgctgcagcatcaaagatcctgggtaacctggtgtaccagtacaaaggcgcaggcctgtctatgggtaccatgatctgcggttacaccaagaaagaaggtccaacgatatactacgtcgactccgacggtacaagactgaagggcgacctgttctgtgtggggtccggtcagacattcgcctacggtgtgctagactccaactacaaatgggacctgtcggtagaagaagccctgtacctgggtaagagatcaatcctggctgccgctcacagagacgcttactccggtggttccatcaacctttaccacgtcacagaagatggttgggtttaccacggtaaccacgacgtgggtcaattgttctgggaaatcaaggaaaaggaaggatctttcaataacgtagtagggtga

SEQ ID NO: 230 - DNA, 846 bp, Aspergillus niger
cccttagtataattccccgttgcttcgtcgaattcatcaacacatcttgcacatcatggataaattggtcgctcaatactcccgcccgccgcatcagaatgagttctactcagagcaagagcagcgggacctcacagagagccttcctccgctctctctgaagttcaacctgcctcctgttgataactctagagccttcctccgtgctatgaccgatgaccactcgaatcccagctgccccattaaacttgcccacggaacgacgacactggccttccgattccagggcggaattatcgtcgctacggattcgagagctactgctggaaactggattgcgagtcagacagtcaagaaggttattcccgtctcgcggttgagccgcggggaggacaagccgtcaaatgaacccactcccgggcttttgggcaccatggccggaggtgctgcggactgccaatactggttgagatacctgagccagcaatgcacacttcacgaaatccgccacaagcgtcgtatcactgtcgccgctgcgtctaagattctcgccaacctgacatatgcctacaagggaatgggtctgagcatgggaacgatgttagcaggaatgacgccccaagaaggacccgctctttactacatcgactcagacggcacccgactccccggaaacctgttctgtgtcggatccggtcagacctttgcatatggtgtgcttgacgccaactaccgctacgacttgaccgaggaggaggccctcgagctcggtcgcagaagtatccttgctgccatgcaccgtgacgcgtactctgggggtttcatccacctgtaccatgtcaagga

SEQ ID NO: 231 - DNA, 659 bp, Aspergillus flavus
ccacctggtctcggcagttatgtctggtgttaccgtcagtcttcgattccctggtcaactcaattccgacctgcgaaaactggctgtgaacatggtgcccttcccccggcttcatttcttcatggtgggctttgcaccactgaccagccgaggggcccattcattccgcgcagtctccgtgcctgaattgacccaacagatgttcgatcccagaaacatgatggctgctgctaatttccacaacggccgctttttgacttgctccgcgatcttccgtggaaaagtctcgacgaaggaggtcgaagatcaaatgcgtggcgtccagactaagaacagcggatacttcgttgaatggatccccaacaatatccaaaccacggtctgctccgtgcctcccaggggcctgaagatggcttcaaccttcatcggtaattcgacatccatccaggaattgttccagcgtatcggcaatcagttctctagcatgttccgtcgcaaggcattcttgcactggtacaccagcgagggtatggacgagatggaattcacggaagcggaaagcaacatgaacgatttggtgtcggaataccagcaataccaagaagcctctatcgatgatgaggaagacattggagagtatggtgaggaagagatcgagg

SEQ ID NO: 232 - DNA, 2793 bp, Candida albicans
atggctccacctcataagaatcataatttccgtccagaaaacgttttaaaacgtgctgaagatttaattgctgttggacaaaaggaagcagcattagatacattatatgaattaattacttcaaaaagaattcgttatttacaagttcaagatttagaacctattgctagtttattgattgaattagcagttgaattaagaaaaggtaaattagctaaagatgcattacatcaatataaaaaaaatattcaattactggaaaatgggttagaaagtgttcaaaccattgttcgtaaatttattgatttagcagaaaagaaattagatgctgctcaaactaaagctgatattaaaattgacgaagaagaaaatgctgctgctgctgctgctgctgctacaagtagtggtggtgctggtgctggtggtgatgcaggtggtgctggtgcaggtggtgatgatgatttagaaactgcacaaactccagaaagtattttattaagtgctgtttccaatactgattcagctgatcgtactgaaagagaattagttactccatggttaagatttttatgggaagcatttagagctgttttagatattttaagaaataattctaaattggaaatcacttattctgctattgttaatcaagcttttaaattttgtttaaatttcaatagaaaagcagaatttagaagattatgtgaattattaagaactcatatgcaatcagttactactcaaactactactaaaactagtggtcataatgccattgatttatccgatgccgaaaccgtgcaacgttatttagatcaaagatttgctcaattgaatattgctgttaaattagaattatggcaagaatcatttagatcagtcgatgatgttcattcattaattactgcatctaaaaaagcaccaaaaccaaatatgatggctaattattatgaaaatttggcaagaatttttgctgtttctgataatactttatatcatgctgctgcttggaataaatttttcaatttatattctcaatcacctttagctactgatgaagaattgaaaagatatgcttcagtcttggttttatcaactttatcaatcccacaaagagtggttcaagatgttgatgaacacaagagtaaaaattctaaattatcttcattattgaatttaactcatgttccaactagagaaggattaattaaatcgattttgtcgagatcaattttgaaatatgttgatgaaccaattcaacaattgtttgaattattagaaggtggtgattttcatccattatcaattaaacaagaaattagtcaactttttcaaatcattgaatccgataaagaatttaaaaaatatattcctactttaactgaagtcattttaattagaatttttcaacaagtttctcaagtttatgatgcagttaaattagatttcttgatttctttaggtattttccccgatttagaatattctttatcggaattacaagttgaagatttgattgttaatgctgttaaagatgatttagtatctttaactattgatcatgaatcaggggttgtttcatttaaatctaatccatttgatgaaattgatcaagaatttgctaatgctggtactaccaccactaacactatcaccaccaccaccaccattggtacttctagattacaaatatcaccagcagaattggttcgtactcaaattagtaaattagctgcgacattaagtgaatcgatttatttgattgatccaaattatgaagctcgtcaacaacaagctaaacaacaagcattacaacgttgtattaaagatatggttaatgaacaacaaagaattgctgatcgttccaagattttgaaagatcgtaaagttgctgctgaaaaacgtaaacgtgaagaagaagaacgtcaagcccgtttaagacaagaaaaattggcaatggaacaaaaattagaacaagaaagattaatagctgaacaagaacgtaaaaaattggaaaaattagagaaagaacgtgaattaattaaagaaaatgaaaaacgtaaaattgctgaagaaattaatgctaaggggatcattaaaattgatttaaataatttgaaagaattagatacgacaaaattacaattgatgcaaattgaacaattaaataaagataaaaaagaattggaaactaaattacaagccacggctaaaaaagctgatcatttagaaagagcttatagaagatatgaattgaatttattagaagctgatttggaaattcaattggatttagaaaagaaagattatgaatttttgaaacaatcgaaaattaataaagctaaaaaagatcatgataatgctattgaattaaagaaaagattacaaagaattttacccgattatagtaaatttaaatcagaaattgatgccaagaatgaagttaaattgaaacaattacaaaaagaagctcaaattaaatttgaaaaggcaaaacaagaacgtattgaatcagttaaaaaacatcgtattgaagaattgaaaattagaaaggaaagagaacgtaaagctgctgctgaagaagcggcaagacaagctaaagctgctgaaatggctaaattgaaagaagaattaagaattcaaaaagaaaaagatgaagctttagcaagaaaaagagctgaattggaagctgctgctgctgccgctgctgctccatcatcatcaccaccaccaaagaaaacaatgacatttgctgaaagaatgagattaaagagagaaggtaaattaccataa

SEQ ID NO: 233 - DNA, 858 bp, Candida albicans
atgaatagtattgctcaaagatatagtcatgccagtcaaaatgatattgttaaagaaataaattccgttcatgaatcactttcatcatcatcaaacattcctcaattagaattagctccatcaattgccatcccgccaatttctcaaccaacagattttttaagagctcatactgatgattctgttaatccagattgtaaaatcaaaattgctcatggtacaacaactttagcatttcgtttccaaggtgggattattgttgccgttgattctcgtgccacagcaggtaattggattgcttcacaaaccgtcaataaagtgattagaattaatccatttttattgggtactatggctggtggtgctgctgattgtcaattttgggaaacttggttaggtactcaatgtagattacatgaattaagagaaaaggaaagaatttctgttgctgctgcatcgaaaattttaagtaatttggtgtatcaatataaaggtatgggattaagtatgggtaccatggtttgtggtcatactgctaaagaaggtcctactatatattatgttgatagtgatggtactagattgaaaggtgatgtgttttgtgttggttctggtcaaacttttgcttatggggttttagattcagaatataaatgggatttatcggttgaagatgctttatatttaggtaagagaagtatattggctgctactcatagagatgcttattctggtggttcagttaatttatatcatgtcactgaacaaggttggacttatcatggtaatttcaatgttggtgatctcttttgggaagttaaagaaaaggaacaatcatttgtaaatgtagatggataa

SEQ ID NO: 234 - DNA, 747 bp, Verticillium dahliae
  misc_feature (645)..(645): n is a, c, g, or t
  misc_feature (654)..(654): n is a, c, g, or t
  misc_feature (658)..(659): n is a, c, g, or t
  misc_feature (747)..(747): n is a, c, g, or t
gtcgttcagcttcctcagccttcccaacatcaagatgcgtgagattgttcacctccagaccggccagtgcggtaaccagatcggtgctgctttctggcagaacatctctggcgagcacggcctcgacagcaatggcgtctacaacggcacttccgagctccagctcgagcgcatgaacgtctacttcaacgaggcctctggcaacaagtacgttccccgtgccgtcctcgtcgatctcgagcccggtaccatggacgccgtccgcgctggtcccttcggccagctcttccgccccgacaacttcgtcttcggccagtccggcgccggcaacaactgggcaaagggtcactacactgagggtgccgagctcgtcgaccaggttctcgatgtcgtccgtcgtgaggctgagggctgcgattgcctccagggtttccagatcacccactccctcggtggtggtaccggtgccggtatgggtactctgctgatctccaagatccgcgaggagttccctgaccgcatgatggctaccttctcggtcgttccctcgcccaaggtttccgacaccgtttgtcgagccctacaacgccacccttttcgtgcaccagctcgttggagaactccgacgaagaccttttggcattngacaacgangctnntttacgacattttgcatcccggaacccttaaagcttgtccaaacccccttggtacggggaaccttaaccaaccttggttttcccgcgn

SEQ ID NO: 235 - DNA, 2793 bp, Candida albicans; identical to SEQ ID NO: 232

SEQ ID NO: 236 - DNA, 879 bp, Paracoccidioides brasiliensis
cgtctaaactagtggatcccgggctgagggtcgttaggtgttttgcgctatcacattcattgcatcgcttagagtggtcatcatggatactgtcgtagcccaatactcccgggctatgttcccaaacgatcgctactcccagaacgaagagcaagagcttacagcaacactgcctcccttgtctctaaatttcgatcttcctccagtagataagcccgccgctttcctgcgagccgcaaccgatgaccatgccaacccaaactgccccattaagcttgctcatggtaccacaactcttgcattcagatttcaaggcggaatcatcgtagcgacagactccagagctaccgctggcaactggatcgcaagtcagactgttaaaaaggtcattgagatcaacagctgtctattggggaccatggctggtggtgctgctgactgtcaatactggctcgcctacctaggcatgcaatgccgcctccacgaactccgccacaaacgccgcatatccgtagctgccgcctccaagatcctcgccaacctcgtctacaactacaagggcatgggattaagcatgggcaccatgtgcgctggtgtaacgccgcaagaaggacctgctctctactacatcgactcagatgggacccgattagcaggaaatctcttttgcgttggatctggacaaacatttgcatacggcgtgctggaacgcggaatatcgatatgaccttgatgaagaagaggcgtaggagctgggggagacggagtatcctcgttggtacacacagagattcgtattcggggtggtttaattaccctgtaccatataagggggctggatggaaaacctggattcagggaaataaccgatttcttgaa

SEQ ID NO: 237 - DNA, 2586 bp, Candida glabrata
atgtctgttcaggaattcgcccagattttagaaaacactattttaagtccagaccaaaatgtgcgtctaactagtgaaacgcaattgaagaagctttctaacgagaactttcttcaatatgccgggttgctagctcaagttttggttttgccagaagcaaaagtcgaagcacgtatattggcagccttgtctttgaagaatgagttggtatcaaaggatagcataaagaatcagcaatttgctcaacgttgggcaaccactatagatcctgagtcaaagcaacagattaaatccaacgctcttgctgttcttatggataatgaaccaagagttgccaatgcttctgcacaattaattgctgcgatcgcggatatagagttaccccgtggagaatggcctgatttgatgcagataatggttgacaatacaaacaccaaccaaccggaaaatgtgaaaagagcttcgctgttggccttgggatatatttgtgaaagtgccgatccccaaagtcaagtactaatggcctcatctaacagcattttaattgcaattgtacaaggtgctcaatcatcagagccttctaaattggtacgtttggctgccttaaatgctcttgcagattccttggtctttattaagaacaatatggaaagagaaggtgaaagaaattatctgatgcaagttgtgtgtgaagctactcaagcaaatgacactgatatccaagctgccgcatttggttgtttatgtaagattatgtctctcttctatgctttcatgaaaccttacatggagcaagccctatacgctctaactatagccactatgaagtcagaggatgataaagttgcatctatggcagttgaattctggtccactatttgtgaagaagaaattgatatcgcatatgaactttcgcagttcccacaatcaccattacaaagttacaacttttctttgtcttctataaaagatgtcttaccaaatttattgaaccttttgatgagacagaatgaggatccagaagacgatgactggaatgtatctatgtcagccggtgcatgtttacagttatttgcccaaaattgtggtaactacgtcctacaaccggttttggagtttgtggagcaaaacatcactaatgataactggagaaatagagaagctgctgtgatggcattcggctctataatggatggtccggataaaacccagaggacctattttgttcatcaagccctacctgcaattctaaacctaattaatgacccatccttgcaagtcaaggaaacagctgcatggtgtataggtagaattgctgaccttgttgcagaatctatcgatccccaagagcatctaccaggtgttattcaatcttgtttggtaggtttacaagaccatcctaaagtcgccacaaacgcagcttggactattatcaatctagtcgagcaactttctgatatgcaaccatctcctatctataactactatccagcattggtagatggattgatcaaatcagcaaacagacctgataacgaatttaatgccagagcatctgcattttcggctatgaccactttaattgaatatgctattgatactgtcagtgatacttcagcatccatttcttcatttgtcatggacaaactaggacaaacaatgactgttgatgaagcccaattatccatggaggatgcacaaagtttgcaggaattacaatcaaatattttaactgttcttgcagcatatatcagaaagagtccaaattccgtggtaaatgtctcagatatgttaatggacctctttgttaaactattaagtagaaagagttccgcttttatcgaagatgatgtattctacgctgtatcagcccttgcatcttcgttaggaaagggttttgaaaactatttagagtcattttctccatatctgattggtgctttgaaccaagtagactccccagttgctatcactgcggtaggttttattgctgatatctcaaactcattggaagatgatttcaagagatacgccggtgcattcatgaatgttttgggtcaattaattacaaacccagcagccaagaaagagttaaagcctgcagttctaagtgtttttggtgatatagcctccaatattggggaagatttcattccatatgtcaatgaagtaatgggattatgtgtggcagctcaaaactctaaaccagaaaatggtactctagaagcccttgactacaacataaaggttcttgagtcagttctggatgcctatgttgggattgttgctggtttacataatcatcctgctgagttatttaattacattggtactatcttccagtttttgaatattgtggctgaagatcctcaactttacagtgaagattctacatccagatcggcagtcgggttgattggtgatatcgcggccatgtacccagatggtagcatcaagcaattttacacacagcaatggattgcagatttcattaaaaagacaagaaagaaccaagagttcagccaatctacaaaggataccgctagatgggctagagaacagcaaaagcatcaactgtcgctctga

SEQ ID NO: 238 - DNA, 842 bp, Gibberella moniliformis
gcacgagggaacaactacttggaccaactcctccacaacaacatatcggctttccttccactacattcaaatcatcgtcaacatggaggtgcttttgggaatcactggaaaggacttcactatcattgcagcatccaaggctgcgatgcggggcgccactatcctcaaggcatccgatgacaagaccagagctcttaacaagcatacacttctcgcattctctggagaggccggcgacacagtgcaatttgccgaatacattcaacgaaatgcccagctctactcgatgcgaaacgagtccgatctttctccgtctggcctggctcacttcgttcgtggagagctagccactagtctgcgatctcgaaagccctacaatgtcaacctcctcatgggtggtgttgaccccatcactggcaagccttcactctactggctcgactatctagcgtcgctagcagatgttccttatgctgcgcatggatacgcacaatactactgcctgtctatcctcgataagcaccatcaccccgatatcacactccaccagggcatcaagatcctgacaatgtgcaccgacgaactgaagcgccgattaccaatcgacttcaagggtatggtagtgaaggcggtcaaggcggatgggatcgtcgacatagagtttgatgatgacaaggttgtcaagtgtgcttgagaccagcgacagactgaaggaaacatgactttgtactactagatcggtattagaggctaatactggcatcgtgaaggtttcccagctttcgtcctgacgatttgttcagaagccgggtcagcgtgaattgagggccgtttcgtttatg

SEQ ID NO: 239 - DNA, 675 bp, Aspergillus flavus
tgatgctcacggacacctgatcggtgctactcgcaagtcaccctccagccacagtgcgcgtggattttatcaatcctctcataagttgctcgtggtggtagagcttcttatgggagacatccccgaccgtgcgatcttccgtcagcctgctctggaacgtgccatgcacccttacttcttgcttgttcaagccgtgagtgtaggtgacctggatggctttttgagcattgtaaatacgcacagtacgacattccgtaaggatggcacgtacaccctcatcctgcgcttgagacaaaacgttataaagaccggaatccggatgatgtcgctgtcttattctcgcatctccctgcgggacatttgcctccgcctggggctggacagtgaggaatcagcggagtacatcgttgccaaagcgatccgggacggtgtgatagaggccactctggaccatgagcgaggatttatgaagagtaaggaagttggagatatttatgcgactagagaacctggcgaggcattccacgaacgcattagagcttgcttgagtctccacgacgagagcgtcaaggctatgagatttcccatgaaccagcatcgcctggaactgaagagtgcacaagaggcccgggaacgcgaacgggaactggccaaggagatccaggatggtgatat

SEQ ID NO: 240 - DNA, 2493 bp, Candida glabrata
atgaatctatcccgtaacgttaaagatttggttgagaaattagaggctgcttcacaattgcctgggagaggaaaagccatcaaacgaatctgtaaactgtcaaactctgatggtcaagtggttagttggaagttcaatgagtgggactacggtaaaaataacatcaaactaccatgctgcgctcgtgggctgtttataactgacgatagcaagaatcctcaaatagttgctcgaggttatgacaaattctttaatattgatgaaactccatttactcgatgggacactttagaaagcgataccaaagggacatacaatgttacgttaaaggctaatgggtgtattatctttgtatctggtatggctgatgggacattagtagtttgttcaaaacactctactgggccaagagatgacgttgacagaaatcatgccgatgctggtgagcaattccttctatcacagttgaaatccattggtatcgagcctcaacaattagcattggaactctatcaaaataatgtaactgcagtggctgaatattgtgatgacacatttgaagagcacatattggagtatacaaatgacgatgttggtttatatttacatggtataaactataatgaaaccacatttaggacatgggatatggatagtgttagtgaatttgccagaaaatacaactttaagcaaattaaatatgaaaattttaatgatttcaccttattaaagaaattcttggaagaatgctccaatagtggaacgtatcatggccaggaggtagaaggttttgtaataagatgtaaaaccagagaaaatgggaatgatttcttctttaagtataaatttgaagaaccctatctaatgtacaggcagtggagagaagttactaaggattatatttcaactaaatccagagttttcaaattcaaaaaacataaatttattaccaataagtatttagattttgtgattccaatcttagattcgagcccggccttatgtgaagagtatatgaagggatttggtattattaaactaaggaatgagtttttgaaagattttggtatgtcgggcttagaaatattgaaccatgaaaaagtattggagttggaaaatgctaataaaattgattatgatactgtagatgaacatacaaaatttttgattattcctgtggctgtaattggttgtggtaaaaccacgacagctatgacaatcaataatatctaccctgaaagttggggacatgttcaaaatgataatattactggcaaagacaactcattactaatgaagcggtctctagagttattagccaagccaggaattaaatgtgtggttgttgacagaaataatcaccaagctagagaaaggaaagagttgtttgactggatagacgagtataaggaagactacttgccctacgatacaaatattaaagtaatttgtctctcgtttaccaaaagagatgacctggaaaatgtcagggagatcacaactaatagagtttttgcaagaggtgatgatcatcaaagtatcaaattgtctaaatatggtgaaaaaaaagttatgggaattatgagcggtttcattaaaagatttcagccagttaatgaagatcgtatgccagatattatgtttgatcatgtcattgatttgactgttacagaaaaggattcttccttgatcaatgctaagagaatcctaaataacttgcatgataagtaccctgttttggtaccaactgtcccgactgatgaagaaatcagagcagcatttgagaagagtttagaatataagccgaccactgtgaaaattatcaatgagaagggcagtagaagaaataaaaataaagacaaaaaacatacatcagccccaactatgaaaaaactgaaacctgtctacttctttgctgaattaagagatccgacgaagttattacggtgtattaaagcttttatagaagagaatcggtcctcaattgataatgatagttatatacatattgacagattgtttcaagataagaaataccaggaaaaactacatgtgacattgattcacttgatgcaaggcaaaaaagggactgagactcaacaacagctgtgggatgattatttacgcagttttgatgagtatctcactgtcaatcctgaaacctttgataagaattgtgatagaatcaaaactaaatattccatcaaagtaacagtccaaagtttatattgggattcaaaaattgccacattaactgttaaacctgaattagtggaagttgaacgtgatggtagcttaaacacattggcttgttgtaatgacatccctcatataactttaggtatcctagaagaaggaattaagccagtatattcaaatgaacttctcaaaatgatgaaccaaaatgacaaagaatcaagaccagctaacagtttctgtttggaattggcagggcttgaggtacaaattgctgatgtttatatacatttatag

SEQ ID NO: 241 - DNA, 523 bp, Fusarium sporotrichioides
tcgatctcgagcccggtaccatggacgccgtccgttctggtcccttcggacagcttttccgacccgacaacttcgttttcggtcaatccggtgccggaaacaactgggccaagggtcattacactgagggagctgaacttgtcgaccaagttctcgatgtcgtccgccgtgaggccgagggctgtgactgcctccagggtttccaaatcacccactctctcggtggtggtaccggtgccggtatgggtaccctgttgatctccaagatccgtgaggagttccccgaccgtatgatggcaactttctccgtcgttccttctcccaaggtctccgacaccgttgttgagccctacaacgccaccctttccgtccatcagctggtcgagaactctgacgaaaccttctgtatcgacaatgaggctctctacgacatctgcatgcgcactctcaagctgtccaacccctcttacggcgacctgaactaccttgtctccgccgtcatgtccggcgttacgacctgtct

SEQ ID NO: 242 - DNA, 777 bp, Gibberella zeae
ttcaatatgccgtcggggaggaraccatctttgtgtaagcattggcctccaggacccatctagtaatacaaattcatgtttcctttccatttgcggtcgcctcttaagcacacttgaccaccttgtcgtcgtcgaactctatgtccacaattccatctgccttgaccgccttgaccaccatacccttgaaatcaagcggtaatcggcgcttcagctcgtcgatgcacatcgtcagaatcttgatgccttggtggagagtgatatcggggtggtggtgcttgtcgaggatggagaggcagtagtattgtgcgtatccatgtgcggcatagggaacctcggccagcgacgctaggtagtcgagccagtagagggatggcttgccagtgatgggatcaacaccacccataagcaggttgacattgtaaggctttcgggatcgcaagctggtggctagctctccacggacaaagtgggcaagagcagagggggataagtcggactcgtttcgcatcgagtagacccsggcatttcgttgaatgtattcggcgaattgcactgtgtcaccggcctctccagagaatgcgagcagcgtgtgcttgttgagagctctggtcttgtcatcggttgtcttgaggatggtggcgcctcgcatcgcagccttggatgctgcgatgatggtgaagtcctttccagtgattcccaaaagtatttccgccatgttggcgatagtgtggtttgtggtgggggragtattagatgtgttgttgtggaggagtt

SEQ ID NO: 243 - DNA, 721 bp, Mycosphaerella graminicola
ttccgacacgaattccatcctctcgtccaccctgtaccttccactccatcacctcgacaacatcgccacacctcctcaaccatggacaccctcgtggctcaatacagccaaccatcacacaccgaggacctggacgacaccgaacagatcaacaccgacctcgcaccgccactctccctgaagttcgccctccctccaatcgcctcatcgcaatcatggctgcgcgcaatgaccgatgatgcctcgaacccaaattgccctatcaagatcgcccacggaaccaccacactcgccttccgcttcaagggcggcatcatcgtcgccacagattctcgagcaacagcaggaaactggattgcaagtcagacggtgaagaaggtcatcgagatcaacagctgtctgttgggtaccatggccggaggagcagctgattgccaatactggctcgcatacctcggtatgcaatgtcgtctccacgaactccgccacaagcgccgcatttccgtcgccgccgcatccaaaatcctcgccaacctcgtctacagctacaagggcatgggcctcagcatgggcaccatgtgcgcgggcgtgacaccatcagagggaccagcgctctactacatcgacagcgacggcacacggttggcgggcaacttgttctgtgttgggtccggtcagacattcgcgtacggcgtgctcgacgcggagtacagctacgatt

SEQ ID NO: 244 - DNA, 523 bp, Fusarium sporotrichioides; identical to SEQ ID NO: 241

SEQ ID NO: 245 - DNA, 891 bp, Aspergillus nidulans FGSC A4
atggatcaattagtccgccaatacacccggtcgccgcaccagaacgagttctactcggagcaagagcagcatgacctaacagagagtctccctccgctctccctgaaattcgcccttcctccagttgcaaaccaatctgccttccttcgtgcgatgactgatgaccactcaaacccaaactgccccatcaaacttgcccacggaacaacaacactcgccttccgatttcagggtggaattattgtctgcacagattcccgagctacggctggaaactggattgccagtcagacggtgaagaaggtcattccggtctcccggttgagccgtggagaggataagccaggcagtgcgcctgttcctggtcttctggggaccatggctggtggtgcagcagactgtcaatattggcttagatatctgagtcaacaatgcacactacatgagattcgtcacaaacgccgtatcacagtggctgccgcttcgaagattctggctaatcttacgtacgcctataaggggtacggtctgagcatgggaacgatgttggcaggcgtaacaccgcaagaaggacctgcgctgtactacattgactccgacggcacccgcctccccggaaatctgttctgtgttggttccggtcaaaccttcgcctacggtgtgctcgacgccaactaccggtacgacctgacggaggaggaggctctcgagctcggacggagaagtattctcgctgccatgcaccgtgacgcttactctggtggtttcatcaatctttatcacgttaaggaggagggatgggtccatcacggcttcgacgatatgaaccccatattctggaagacgaagttggagaaaggcgagttctcgaatgttacgtcggcgttgtag

SEQ ID NO: 246 - DNA, 712 bp, Aspergillus niger
acaagaacacccgtctcaccaacctgttgggtatggcctctccccccactcgtgctgtgctgttcaaggatgccctgaacaagggtctgctcaagcgcgcccgccccgagatccgtgacctctacaacatcctggaggtggacttccaccccctgtccatctgcaagaagatcacccccatcctcaagcagatcggtgccgaccccgagatggagaagtacgtcctgcctctgcagcaggtcatcctgacccgtctcttccagcagctgtctcaggtctatgagtcggtcgagctcaaattcgtctacgagctggctcagttccccgaccccttccagatcaccccctccatgatcgagaagttcatcatgaacggctgcaagaagggcgatctcgccatccgcgtcgaccacatctccggtgtcctcaccttcgacaccgacgtcttctcctcggccaaggctctgcaccccggcagcgccgctggctccgccgagagcgaggttggctccgtccagcgcctgcagaacacccccgctgagattgcccgcctgcagctcacccgcctggccaagaccctgcatgtgacctgcatgtacgtcgacccctcgtacaacgaggcccgcctgcaggccaagcgtgccgccctcgctcgcgccgaggctggtgccgccaaggagcacgaggagactctggctcgccgcgtcatcat

SEQ ID NO: 247 - DNA, 712 bp, Aspergillus niger; identical to SEQ ID NO: 246

SEQ ID NO: 248 - DNA, 639 bp, Aspergillus fumigatus
atgccggccgtcttatgtgcaggccgcaaggaggttctactaggtatcaccggcaaggacttcgtcatcctggcggcctccaaagccgctatgagagggccgactattctgaaagcagaggatgacaagacacggcaactgagccagcacactctaatggctttttcgggagaggcaggagatacagtgcaatttgccgaatacattcaagctaatgttgcgctatacacgatgaggaacgacacagaattgcgtccgaatgctgttgccaactttgtccgaggagaattggctcggagtttgagatcgcggaacccctacacggtcaacctcctgttgggcggagtggactccattacacaggaacctcacctgtattggattgactacttgtctgcgcttgctcgcgtaccctacgccgcacacggctatgctcagtactactgcttatccatcctcgacaaacaccatcatcccgatatttccctcgaacagggtatgaagcttctacagatgtgcacagacgagctcaagcgcagactaccgatcgattacaagggcgttcttgtaaaggtcgtgaccaaggatggcgtcaaggaagcagagatcgataatgatagaatagtcaagagtgcttaa

SEQ ID NO: 249 - DNA, 781 bp, Alternaria brassicicola
  misc_feature (30)..(30): n is a, c, g, or t
gcgcgggattaagcagtggtatcaacgcanagtacttttttttttttttttttttttttttttcggggacaatgtttgattatagcatcttttggctaacaagaagttgagacgcctgccatgtctgtctagtcaaagccaggtcgctcaaagtacgaatcgaattacagcgcgggtccacacgtgaaagtttccaacaaccaagcccagcgggatatcacccacgaccagcttactcctcagcctcgagaggagcctcctcgtcgtactcatcctcaccctcggaaacggaagcctcctggtattgctggtactcggagaccaagtcgttcatgttggactcggcctcggtgaactccatctcgtccataccctcaccagtgtaccaatgcaagaaagccttgcgcctgaacatggcagtgaactggtcaccgacacgctggaacagctcctgaatagaggtcgagttaccgacaaaggtggaggacatcttcaggccacggggagggatggagcaaagggcggcctggacgttgttggggatccactcaacaaagtatgacgagttcttgttctggacgttgcgcatctggtcctcgacctccttcatcgagaccttaccgcggaagtaggcaaagcaggtcaggtagcgaccgttgcggaagtcggaagcacccatcatgttcttggggtcgaacatctgctgagtgagctcggcaacggtgacggcccgaaaggagtgggcaccgccgtttggggaggggagcgaacctaaccttgg

SEQ ID NO: 250 - DNA, 1446 bp, Candida albicans
atgcaagaatctaaggatattaaaatgaaggatgttcagcaagatgatgtatcctctgaaatagacacattggtcaaggaaattgaacagtcttttattttgttaagtaaagttgccacaactttcgacaatagatacgtttcaaaagtgttcagagacttgggtccattgagaagaaaattggtcaggaatgggaattcagtgttagcaactgtcataaacaacacatacccgcaaactcataactcaaaaacatatttattaaagtatttgaatgaatcgccaacttcagtgggaaacgatgcaatggatgttgataataccacattgattccagaaattgaactttacatacatctcttggttcaagtttatcttttagatactggtaaattggaagaattgaattccttaggagaacatgtggtccaattgatgaaatcattcaatagacgttcattggactttattcaggcaaaggtatggttttatgtatgcagggctaaagagttgattggagatttatattcgattcgtccagagttactgtacagtttgagaacagccaccttgagacatgatatagaaacaacagcatcggtcatcacattactattaagaaattacttattgacccacgacatcagtcaagcttctgatttggtagaaaaagtcgaatttcctgaaaatgctggtaatgcgttagttgctagatactattactatttggcaagaatcaatgccatccagttggactattctactgcaaatgagtgtgttataaccgcgatcagaaaagcaccacaaacatctttagccaacggatttgtccaagcagctactaaattgagcattgttattgaattgttaatgggagatattccggaattgaaagttttcaaaaacaagtctggcaatttggaaccttacttcaatgttactaaggccgtgagattgggtgatattaagttatttggtgaggtattgcacaagtttgaagctgacttcaaaaaggatgacaatttcactttggtttctagattacgtcagaacgttataaagacaggtattagaatcatatcattgtcatactccaaaatatcgttaaaggatatatgcatcaaattgcatttggattctgaggaatcaacagaatacattgtttccaaagctataagagatggtgtcatagaggccagcatcaaccatcaaaagggatacatgcaaagtaaagaattgttggatgtgtactctacaaaattgcctcaagcagagtttgaccaaagaattaagttctgtttgtcattgcataatgagagtgtcaaatccatgagatatccaaatgataatgaaaaagaaaataccaacaaagaaattgaaccaagtgaggaagttgaattattgaaagctattgaagaaggagatttggatgactttatggattaa

SEQ ID NO: 251 - DNA, 1446 bp, Candida albicans; identical to SEQ ID NO: 250

SEQ ID NO: 252 - DNA, 2628 bp, Candida albicans
atggatattcttcaaatattagaagctgctttgggtacagcagatccaaatcaacgaactcaagcagaaatacaattgaatgaagcagcaaataatcatttccccgaatatcttcaattattaattgaagctttagtcaatgaagatgctaaaactgaagtgagaatgttggctggtcttgccttaaaaaatcaattagttgccaaagataataaaacaaaattggctcaacaagaaagatggttaaaattagatggagaattgaaatctaaaattaaacaaacggctcttcaaggtttaaatataactgatcaaaaagttgccaatactgctgctcaattagttgctgctattgccgatattgaattacctagagcagaatggtcagaattaatacctacaattatggaaaataccaagactgataatccagaaaatgtgaaaagaagttcacttttggccattggatatatttgtgaaagtgctgaccctaatgatcccaacattttaagtcaagctagtggtattttgattgctgttgttcaaggagctcaaagtagtgaaccttctaaacaagtaagattaaccgcattgaatgctttagtaaattctttggaatttataaaatttaattttgaaaatgaaggtgaaagaaattatattatgcaagttgtttgtgaagctactcaagctgatgattcagaattacaagctagtgcttttggttgtttagcaagaatcatgtcattatattatcggtttatgtcactttatatggaaaaggcattatatggattaaccatttctggtatgcaaagtgctgatgaaaaagtttcatgcatggccgttgaattttggtctacagtttgtgaagaagaattagaaattgccttacaaaaacatgaattaggtttagattctttacaagcagctcaaaaccccgatttaataacttttaattttgcccttattgcatcaggtgaagtattacctacattattaacgttattaaccagacaaaatgaagatcctgaagatgatgattggtcggttgccatggctgctggtgcctgtttacaattatttgctcaaaacattggtaattatgttgttgaaccaaccatacattttgttggatccaatttagccaataaagagaattggagagctagagaagccgccgttatggcttttggatcaattttggatggacctgatcatgaacaattgaaacatattattgcagaagctttacaaccaatacttttattgattaaagattctgatttacaagtgaaagaaacggtggcttggtgtcttggaagaattgccgatatggttgttgatgccattgatattgaaacccaattacccaatttattgatggcattagttgatggattacaagatcatgctaaagtggccaccaattgttgttggactttgatcaatttagtcgaacaattgtgtactgattattatgaaaaagacagtactgtaatgtcaccatattattccaccataatccccattttaattcaaacatcagctagaaatgataatgaatataatgctagagcttctgcttatgaagctctttccacatttgtcacttatagtgcccaagatactatgccaattgtgcaaaacattgctactgaagtgttgggaagattagaatctagtattattttacaaagtcaagtcaccaccactgaagacaaggggaatttagaagaattacaatccaatattttgtcattattgaccaatgttattagaagattaaacagtgaagtgataatagcagcagataatttgatggatagatttattaaattacttgatgctcaagaacaaaattcattaattgaagaagatattttcattgctgtatctgctctttcaagtgccattggtggtgatttcattaaatatttagatgcatttttaccatatttaagaaaggctttacaaaatgttgaatcatcaacgtgtattactgcagttgggttagtggcagatttggctcaatcaataggatctcaaatgggtaattattgggaaaatcttttacaattacttggtaatgccttgacaaatgccgattccaaaaaagaattaaagcccgccgttgtatctgcatttggtgatattgccactgccattggtcctgattttgctccttatcttgaatttgtgttgagaacatgtactgaagcgggtaatattcaacctcaagatggatcaattgatacgttggattttgttttcaatgtaagggaatcagtattagattgttttgttggtattgttggaggattcataaatcaacctcaagctttagcaccagcaattgtcaccatattacaatatttacaaaaagttacccttgatcctcaaatgtcaagtagtgaatcggttgcacgttccgctgctggtcttttgggtgacattgctgcaatgtatccaaatggtgaatttaaacaagtatttactgaagaatgggtcactgattttattaaaagaactagatcaaatccattgtttgataataaaacaaaggatgcagcaaggtgggctagagatcaacaaaaaagacaacaacaacaactttttggtcaataa

SEQ ID NO: 253 - DNA, 696 bp, Botryotinia fuckeliana
cttacttggaataactggcaaggactttaccatcattgcagcttcaaaggctgccatgagaggtgcaaccattctcaaagcttcagatgacaagacaagagcattaaatcaacataccttgatggcattctctggagaggctggagatacaattcaattcgcagaatatattcaagccaacgctcaactttactccatgcgcaataacatcgacctctccccatccgcagttgctcactttgtccgtggtgagctagcacaatctcttcgctcccgcaaaccatataatgtcaaccttctccttggcggtgttgatcctattaccgacaagcccagtctatactggctcgattacctagcgtcacttgcaccccttccatatgcagctcacggctatgcacaatactactgcttgtctatccttgataaacatcaccacccagatattgatttcgaacaaggaatgaaggttttgaggatgtgtacagatgagttgaagaggaggttgccgattgatttcaagggaatgactgttaaggtattacgaaggaaggaataaggaactcgattatgatgacagtgcaagatttgactgcccatagaggcttgattcgaggatgatcctttaccaagggccttttatgacacaggagataaactatgaattgaggtatgggtgtatattagccgtggaat

SEQ ID NO: 254 - DNA, 644 bp, Sclerotinia sclerotiorum
gatacaacaacatcaaatctatcagcgacatcaatcccacggatctatcatatccctcagttgattttctcaaactccacataaaaatctcgatttcggagatggactccatagtatcaaaatacagtacgccctcgtacgagcaagaagcgccccaagaagaccaaatggagctataccaaccagctccaggcttgtctttgaagttcgccatgcctcctgtcgcacatccatccgcttggctccgagcagctacagatgaccatgcgaacccaaactgtcccatcaagatcgcacacggtactacaacgttagcattcagatttcaaggcggaattattgtagcgacagattctagagcaacggctggcaactggattgcaagtcaaactgttaagaaagttattgaaatcaacaattgcttattgggtacaatggctggtggtgctgctgattgtcaatactggcttgcatacctcggtatgcaatgtagacttcacgaacttcgtcacaaacgccgtatttccgtagcagctgcatccaagatacttgcaaacctcgtttacagatacaaaggtatgggcttgtctatgggaactatgtgtgctggtgttacgaaggaggaagggcctgcactttactac

SEQ ID NO: 255 - DNA, 1727 bp, Cryptococcus neoformans var.
cagtctgtcaccgccatggctaatcaaccagaaaagctcgcagacgcccagaacaaagacgctggcgagaaggtccaggagacagaagagaagactgtcgtggaagctgtcccaaccgtcgaagaggaaatcctcaacaacatcgctttgatcggtcgggccgtcaccactatcgagcctcgattcactatccgtgttttgcgaaccttgacgtctttgaggaagaagttgacaaagaacgctttgaagactgtcttggacgatgctttccctaaaggatccaagactggtcaaactctcattgcctcgcccatcttttcctccctccccgaatctgcacccgccgctactgaacaacaatcagatgcgatggaaatcgactcttctatccccgctgctgaaggaactaccgcccccacccctaagaagaagtttgttccccccatatattctgccactggtgaccttttacctgaggggattgtgtatttgaggctgcttttgattctcgccaacctcgatgcagggcgcgttgtcgaggcaggagactttgcaatggagactgcagacctaattagctcttggaacagacggacaatggaccagcttgctggcaagatttggttctacgtcgcccgcgcttatgagcttcaaggccgtttggctgaactccaacctcaattcatggctattcgacagaccgccgctctgaggaaagatgagacccttgaggttactgtcctcaaccttctcttgcgatcttacctcgccaactctcaatacgaacaagccgaaaagctcgtttccaagactcaatttcacggtgccgccaaccaggctcagactgtccgatggttattctacactgggcgacttcgagccattcagctcaactatgctgaagcccgaaattaccttcagacagcgatcaggagagcgccgaaagacgaagttgcccccggatttgtccagcttatccacaagtactttatcatcgttgtgttgttgactggtgtcattcccgaccgagccttgttccgcaagccagtcctcaaacaagctcttgccccttacttccaaattgttcaagccgtacgtatcggtgacgttgccggtttccaaaaagctttccaaacccatgaagccacctttttcgccgactctacccatttcctcatctctcgtttgcgacactttgtcatcaagaccgctttgcgtaccatcactcttgcttactcccgcatttcccttgccgatgtctgtatcaagctccacctcgactcggaggaggacacagaatacattgtcgccaaggcgattaaggatggagtgattgatgcgacgattgacccgcaaggtggatggatgcagagcaaggtcgcgaaagacctctatgagacggatgagccggcgaagcagttccagaagagggtgcaatactgcactcaggtgtataacgagagtgttagggcgatgcgatatcctccagacgctcaccgtaaagaactagactctgcggccgagtcgcgtgaacgagaccgagaaatcgcgcagcttattcaggagagtgacgagcctgatgacatggatgacatgggagatttgtagagaggaaagatggaaatagaacaattgcccagacagctcttttgtgtgaaggattcagcatgaattaatggcatgtagatgtctattcgtacacgaataaagaaggatatgaatatagg

SEQ ID NO: 256 - DNA, 1806 bp, Ustilago maydis
atgccagagctagtccaggtttccaaggaggatgcaacgggtgcatcagcagccgagacagccaataccgctgtcgtcaagcctcccagcgagaaggagcagctcctcgcactgcttcgtcacaactttttgttgatcgagcgtagtgtgtcgcatatcgagcagcgcttcaccgcgcgtgtgcttcgcactcttccgtacgtcaggagaaaggtcggcgcctacccggaggtattggcgctggcagttcaggaaggcatcctagccaacggtcaagacgattcatcgatccagaagcacttgctctcctttttgcctgccccctacaagcccgagcctccttccgccagcaatgccggctcgactacgacggctgcttccgatgcaatggatatcgattctgccgaacctaaagctgaagctgacaaggacgccaagacgacttccgctgctgcggcacaagcctcgaagcccgcccagaggcagcctgaagctcaacccgagttggttgcctacctgcgtctgctcacgctcgtgcttctgatcgacaacaagaagcttgatgctgcttcggacgaggcagtggcatctatctcgaccatcacggcacaaaaccgtcggacgcttgatcacctcgccgccaagaccatcttctaccttggacgtgctcaggaactcaaggcggagcaggcgcaggcaaaaggcacacgcgtcgaggggggtctcacttctattcgaagccagctgcttggcttgcagcgaaccgcgtcgctgcgtcatgacactgagaccgaggcgacgatcattaatctgctgctcaggtcgtacattgtcgaggccaacttgtacgatcaggcggacaagttggtagctcgtgctccattcccgcgatcgagcgccagcaacccgcaggtggctaggtacgattactatgtagggcgtattcgtgcggtgcagctcgactacacgcaggcgcacgtgcacttgcagcaagcgattcgacgtgctcctcaagcctcgcttccacaagagtcgggtagtgctggcagcgaggccggcgctaatggcatcgccgcgaccactgcggttggcggaaagaaggaggcaagcggcaagaaaggctctaccacggtgggccagtctcaacctgcagctggtttcttgcagacggcctataagtttttggtggtcgtcgagctgttgatgggagaaattccggaacgatccatcttccgcaccccggtgctgcgcaaagcgttggcaccttatatggagattgttcaagcggtgcgcgtcggtgatctgcaacgcttccaatcgacgctgcaacaacacacgacgctcttccagacggacaagacgttgtcgctgatcgttcgacttcgacacaatgtgattaagacggggattcggatgatctcgctctcgtactcgcgtatctcgctggctgatatcacgcacaagctacacctcgagtcggaggaggacgccgagtacattgtggccaaagcgatccgcgacaacgtggtggacagccgagataccagggtggaccacgaaaaggccgagatggtcaacagggagaccaaggatctgtacgagacggacgagcccatgcagcagttccagcagaggatccagttctgcctgcagctgcataacgaaagtgtcaaggctatgaggtatccgttgaacggtcataagaaggagcttgatagtgtggccgaggcgcacgagcgtgagagagagctggctgccgagatcgcggatggcgagatggatgacagcgatgacgattgggcatag

SEQ ID NO: 257 - DNA, 742 bp, Gibberella zeae
gcacgagggccaaatttcacagcgacaaccgccgccatgggtatcgatctcgaccgccaccacgttaagggcactcaccgcactgcccccaagagcgacaatgtctacctcaagctcttggtgaagctctaccgcttcctggctcgccgaaccgatgcctctttcaacaaggttgttcttcgacgtctgtttacgtccaagatcaaccgacctcccgtctccttgtcccgcattgtcgccaacatcaacaaggagggtgagaagcgaaccgtcgttgttgtcggtaccatcaccgacgacaaccgtctgctcgagtgccccaaggtgaccgtcgctgctctgcgattcaccgccaccgcccgtgcccgcatcctcgctgctggtggtgaggctatcaccctggaccagcttgctctccgtgcccccactggaagcaacaccctgatcctccgtggccccaagaacgcccgtgaggctgtcaagcacttcggcttcggtccccatagccacaagaagcctcatgtcgagtcaaagggtcgcaagttcgagcgtgcccgtggccgaagacgttctcgtggtttcaaggtctaagcggtttcaaggtgaaaattattggccttgggtggagttggggccagtttatggggcaaatgatgccgaacatcggcttgcaaatgggtcttgcatggaattggcgtgcctaggtatcacaaaattctacaatgaacttctcgcgcattgc

SEQ ID NO: 258 - DNA, 555 bp, Gibberella zeae PH-1
atgggtatcgatctcgaccgccaccacgttaagggcactcaccgcactgcccccaagagcgacaatgtctacctcaagctcttggtgaagctctaccgcttcctggctcgccgaaccgatgcctctttcaacaaggttgttcttcgacgtctgtttacgtccaagatcaaccgacctcccgtctccttgtcccgcattgtcgccaacatcaacaaggagggtgagaagcgaaccgtcgttgttgtcggtaccatcaccgacgacaaccgtctgctcgagtgccccaaggtgaccgtcgctgctctgcgattcaccgccaccgcccgtgcccgcatcctcgctgctggtggtgaggctatcaccctggaccagcttgctctccgtgcccccactggaagcaacaccctgatcctccgtggccccaagaacgcccgtgaggctgtcaagcacttcggcttcggtccccatagccacaagaagcctcatgtcgagtcaaagggtcgcaagttcgagcgtgcccgtggccgaagacgttctcgtggtttcaaggtctaa

SEQ ID NO: 259 - DNA, 1178 bp, Paracoccidioides brasiliensis
  misc_feature (674)..(674): n is a, c, g, or t
  misc_feature (842)..(843): n is a, c, g, or t
caatcatgccgttttgaggaccctaggccttttttttaagaaaatacccagagcgttacctgtggcatgtcatggaggtcttacttggtatcactggcaaggacttcactctcattgcggcgtccaaagctgccatgagaggccccaccgtcctcaaggccgcagatgacaagacgcgggagctgaacaagcataccctcatggcattttccggcgaagctggtgacacagttcaatttgccgaatacattcaagcaaacgtccaactatattccatgagaaacgaaactgaactcagcccgtcggccgtcgccaacttcgtacgaggagagctttcctgcagcttacgatctagacgaccttacaccgtaaacctcctgctgggtggtgtagatcccatcacggagaaacccagtctgtactggctggattacctagcggcgcttgccccggtgccatatgctgcacacggctatgcccaatactactgcctctcaatccttgataaacaccaccacccaaatatcacctttgagcaaggtttgaagcttctccagatgtgcacggacgaactcaagcggagataccccctgactcttaaagcggccttggggcccccctcgcgaacggggggctcgacaagtaatttgtaacagtagcagttcgcccgcttnacttggttacttggtcgggacaggatttcctagcattttacgactcgatgaatgacttatcgttacaaacaaacagcgggggcggacatcgctggacttacccgcgtacggaggaaccgtccacgaccatctgtaaggggccccggaatgattttaatacataaatcnncccacccccaccacacacaccccacacaccaccccaacccccccctcaccacacacaaacacccacatacaccaacacagcaacacacccacacaacacaccaacacctcatcacacaaccaaaccaccacaccccacctcataccacaacacaacactaactaacccccaccacaccaaaacactaacccacactacctacaccaacccctccaacaccatcacacacactaaacaaacaccacaaccaaccccccccacaccacaccactcattcagccaaacaccaccactacccaacaccactacccaacccgacaccacacacactcact

SEQ ID NO: 260 - DNA, 660 bp, Aspergillus flavus
ctagccaactcccaggtgtcccatcagtcttagcagccatgggtatcgacttggatcgccaccatgtgcgtagcagccatcgcaaggcgccgaaaagcgagaatgtctatctgcaagttttggtgaagctctatcgcttcctcgcccgtcgcacggactccaacttcaacaaggtcgtgctgcgtcgtcttttcatgtcgagaattaaccgcccccctgtttctctgtcgcgtatcgcttccaacgtgaccgatgcgcacaagggcaagaccatcgtcgttattggctccgttactgacgacaaccgcctgcttaacgtcccgaagctgtctgtggctgccttgcgcttcactgctactgccagagccagaatcgagaaggccggcggagaaacattgaccctggatcaacttgctctccgggctcctactggagcgaacacacttctcctccgtggacccaagaacgctcgtgaggcagtcaagcacttcggctttggtcctcatagccacaagaaaccctacgtgcgaagcaagggacgcaagtttgagagggcccgtggaaggagaaggtctcgtggcttcaaggtttaaaggagctcatcaccaaaaatatcttgtatcaaggtcgtaactgtcatgaccatggaaatacatgcgc

SEQ ID NO: 261 - DNA, 555 bp, Aspergillus nidulans FGSC A4
atgggtatcgacttggaccgccaccatgtgcgcagcacccaccgcaaggcgccgaaaagcgagaacgtctacttgcaggttctcgtgaagctctaccgcttccttgcccgccgcacggaatcgaacttcaacaaggttgtgctgcgccgccttttcatgtcccgtatcaaccgtccccctgtgtcgctgtcccgcatcgcctcgaacgttaccgaatctcaccagggcaagaccatcgttgttatcggaactgttaccgatgataaccgtctccttactgttcccaagctttccgtggccgctctgcgctttaccgcgacggccagagcccgtatcgagaaggctggtggtgagactctcaccctggaccagctagctttgcgggcgccaactggagccaacactcttcttctccgtggtcctaagaacgccagagaagcggtgaagcactttggcttcggaccccacaagcacaagaaaccgtatgtgcgaagcaagggtcgaaagttcgagcgtgctcgtggtcgcagaaggtctcgcggtttcaaggtctaa

SEQ ID NO: 262 - DNA, 695 bp, Verticillium dahliae
  misc_feature (551)..(551): n is a, c, g, or t
  misc_feature (600)..(600): n is a, c, g, or t
  misc_feature (608)..(608): n is a, c, g, or t
  misc_feature (633)..(633): n is a, c, g, or t
acattcttgaggttgacttccaccctctttccatttgccagaagatctcccccatcctaaccaagattggtgacgatgccgagatggagaagtatgtcctgcctctgcagcaggtcatcctcacccgcctcttccagcagctgtctcaggtctacgaaacggtggacctcagctttgttgagcagctcgccaagttccctgagcctttccaggttactcgcggtaccattgagaagttcatcatgaacggaaacaagaagggcgatctcgccatccgcatggaccacgctactggtgtcctaagcttcgacaacgatgtcttctcgtccgccaaggctgctcactctgcatctggcgctggctccgccgaggctgacggcagctccgtccagcgcctccagagcaccccctccgagattgtccgctcgcagctgacccgcctcaccaagtctctgtacaccacttgcttctacattgaccctgagttcaacaagtcccgcgtcgatgctcgggaggccgctttggcccgtgccaaggccggcgccgagaangagcacccgtgagcttctcgctcgcaaggacgtcattcagaagcgcaangggaagangctttccgagatccaagctcgtaanggagcggtgagaacccccgccaagaagcgcctgcgtggagcaagaatcctccaaggaagcag

SEQ ID NO: 263 - DNA, 1887 bp, Aspergillus fumigatus
atggtcgctccaagacataatgcttatgcagaggagagcgcagaggtcgaggtgctgtacgccaacctcgagaagctcaagctcctcaccaagaagattcagggctccctggtccgcctcgagaccgggggtaacgtcgtaaagcatgcgataggtcctatctacagcaatacacaatctctccagataaccaacagcaacatcgacaaggtcaatgaagccatcgagcgccttcgtcagccactcgatgcgaagaatcgtgaggagggtatcatccgcgctggaccgcagagcgtagaattgtctcagtatctggcagcgatgaaacgcgtggacaaagctttggtcgatctgagttcaacaaacctcaaatctaatcagaaggcaatctccgaattcaacaacctccttagtacaggtaatgcgaaacttcaggacatgcttcgtgggatcttgaatcagtacgctagtccgattgagccattgcattatttaacgaaagacctcccgttcccatcaataccacaagagacgatctcggagttaacgtcgatatgcgcggcaatcgactcggcagcaagtcacggaccacagcgcggtgatggaggcaatccggcgctcaaaatatacgccgatgtgcgtggggcgtacctgacgtcaagtctacagaatcttgccatagcctcgctgaatactgtcaaacgaagagctgcggacggcccttacaagcagggcactaacggtatagggatatactccaacgcgctcgaaaacttcatatctaccgaatacgagattattgctcagatcttcacaggcgaccagcgagggctagctctgcaaacgacgttccgatctgcgctggccgaatactcaaaaaccttgcgtgagctcaacgagtatatcaaggccaatctgatgacagactgcttcttagcgttcgagatcatcgaaattgtcacggcgatgtcttaccgcgttgactcgaggacgggcgagctaaagagcttgttcatagaagctcttcggccagttcgtgagacggcaaagtcatctctctcggagctcctcgaggaaacaaaacgcaaagccgcgagcatccctgttcttcctcctgacggcggatcggtccctcttgtgaacgaagtgatgagctcgctcactacattgactggttattccggaccgttagcatccatcttaacttccttaggtgacggcaactggcgctccacagccaatgcgtcagggactgctcctttagatgtcagtccagacagctcagctttgttatcacactttatcctggatatgatcgaagctctgatgagttctctcgaggctcgaggccgagcacttcatcgttcaaaagccgtgcaaggcgtcttcctgtccaatgtcttctgcattgtcgatcgcgctattcgacaaagccctgagttggcacgccatttgggtacgccagacagtatcgcgcgtatagacacctttcggaagcgggccacgtccacttatcttgatgcgtggaaagaaacatcgcagtatctcctggatgtgcagtatacgtcgcgtgccggagcccgaccagcttctggtggcattgtcgattccagcgcaatagtcaagtcgctgtcatccaaggacaaggacgccatcaaggacaagttcaaggcattcaatgcaagcttcgatgaactggtcaaccgtcacaaggctctgtacatggaacgagaagtacgcggagtattggcacgtgaggtacaggccgttttagaaccactatatgcgcggttttgggaccgctaccacgaaattgataagggcaggggcaagtatgtcaaatatgacaaaggaagtctctctgcgcagttggctgcattggcataa

SEQ ID NO: 264 - DNA, 759 bp, Aspergillus flavus
tggcggctcgaggagctagccaactcccaggtgtcccatcagtcttagcagccatgggtatcgacttggatcgccaccatgtgcgtagcagccatcgcaaggcgccgaaaagcgagaatgtctatctgcaagttttggtgaagctctatcgcttcctcgcccgtcgcacggactccaacttcaacaaggtcgtgctgcgtcgtcttttcatgtcgagaattaaccgcccccctgtttctctgtcgcgtatcgcttccaacgtgaccgatgcgcacaagggcaagaccatcgtcgttattggctccgttactgacgacaaccgcctgcttaacgtcccgaagctgtctgtggctgccttgcgcttcactgctactgccagagccagaatcgagaaggccggcggagaaacattgaccctggatcaacttgctctccgggctcctactggagcgaacacacttctcctccgtggacccaagaacgctcgtgaggcagtcaagcacttcggctttggtcctcatagccacaagaaaccctacgtgcgaagcaagggacgcaagtttgagagggcccgtggaaggagaaggtctcgtggcttcaaggtttaaaggagctcatcacgaaaaatatcttgtatcagggtcgtaactgtcatgaccatggaaatacatgcgcaccggccttgtgatcttgtgctcgacctttttacttagaatacggctagctctaaaacatttagctggtacggcagcgaccctc

SEQ ID NO: 265 - DNA, 745 bp, Aspergillus niger
gtcaactttcaggtgtcccatcaataacagcagccatgggtatcgacttggaccgccaccatgtgcgcggcacccatcgcaaggcgcccaagagcgagaacgtctacctgcaagtcttggtgaagctctaccgattcctcgcccgtcgtacggaatccaacttcaacaaggtcgtcttgcgccgccttttcatgtccaggatcaatcgcccccccgtttcgctctcgcgcattgtatccaatgtgaccgactcccacaagggcaagactatcgttgtgatcggcaccatcactgacgacaaccgtcttctgactgtcccgaagctgtctattgcagcacttcgtttcacggctactgctcgggccaggattgagaaggctggtggtgaggtcttgactttggaccagctcgctctgcgtgcccctactggagcaaacactctccttctccgcggacctaagaatgctcgggaggcagtgaagcacttcggtttcggcccccacagccacaagaaaccctacgttcgcagcaagggacgtaagttcgagagagcccgtggacgcagaaggtctcgcggtttcaaggtgtaaggaacgctggttaaatattttccgtttcttgtgtctggtagcggttcatcgtgctggtgaagacgacttgcggaatcatgcatacccgggagtcttccttatcggccgttggctccaactttttttagaacgcccgatgccagaccaaatattat

SEQ ID NO: 266 - DNA, 555 bp, Aspergillus fumigatus
atgggtatcgacctggaccgtcaccatgtgcgcagcacccatcgcaaggcgccgaagagcgaaaatgtctaccttcaggtccttgtgaagctctaccgctttctcgcccgccgcacggagtccaacttcaacaaagttgtgctgcgccgcctttttatgtcgagaatcaaccgccctcccgtctccctttcgcgactcgtttccaatgttaccgatgctcacaagggcaagaccatcgttgtgatcggaactattactgatgacaatcgccttctcactgttcccaaactctctgttgccgcgttgcggttcaccgctactgcgagagccagaattgagaaggctgggggtgagactctgactttggatcagctcgcacttcgggcacctactggagcgaacactctcctcctccgtggccctaagaacgctcgtgaagctgtcaagcacttcggatttggaccccacagccacaagaaaccgtacgttaggagcaagggccggaaattcgagagagctcgcggacgtagaaggtctcgtggcttcaaggtttaa

SEQ ID NO: 267 - DNA, 1887 bp, Aspergillus fumigatus; identical to SEQ ID NO: 263

SEQ ID NO: 268 - DNA, 724 bp, Paracoccidioides brasiliensis
  misc_feature (36)..(36): n is a, c, g, or t
cctgcaggtatcggcacgaggagatcgtatcacacnttgaagaaatgcaaaccagcttgacgagtgtgctattggctatcgtgcaacgactggaaggagagatcaagcctcaagccgatcgtatcatgcacgttctgttgcaagttttgtccactgtacctccaaaatcaagtgttccagataccgtcttcgccactgttggctcgatagccagcgctcttgaggcagacttcctcaagtatatggattcgttcattccgttcctttataatgccctgggtaatcaggaagaggctgccctctgtgccatggcgattggattagttagcgatatcactcgatcgtcgggcgaaaaggcacaaccttactgtgatacgttcatgaatcatcttctcaacaacttgaggagcactacactcagcaaccagcttaaaccatcgattctcgagacttttggggacattgctcaggctatcgggacccatttcgagacgtatttggttgttgtcgctggcgtgctgcagcaggcatctggtgtgacggcttctcctgatgtgtccttcgatatgcttgattatattgtttcccttcgagaagggattatggatgcttggggtggcattctacttgcatacaagggctcaccaaatgttaacgcatttgatccatatgtggagtcgatttccagttgctaaatacattgctcaagatacaatcggagcga

SEQ ID NO: 269 - DNA, 658 bp, Ustilago maydis
  misc_feature (576)..(576): n is a, c, g, or t
  misc_feature (585)..(585): n is a, c, g, or t
  misc_feature (607)..(607): n is a, c, g, or t
  misc_feature (624)..(624): n is a, c, g, or t
  misc_feature (628)..(628): n is a, c, g, or t
  misc_feature (630)..(630): n is a, c, g, or t
  misc_feature (648)..(648): n is a, c, g, or t
  misc_feature (655)..(656): n is a, c, g, or t
ggggaggtgtacatttcatatcagcagccatgggtatcgacctggaccgtcaccatgtgcgcagcacccaccgcaaggcgcccaagagcgagaacgtgtacttgcaggtgctggtgaagctctaccgcttcttggctcgccgcacggagtcaaacttcaacaaggccgttctccgccgcctgttcatgtcgcgcatcaaccgcccccccgtctccctctcgcgcgttgtttccaacatcagcgaggctcagaagggcaagaccgttgttgtgatcggtaccatcaccgatgacaaccgcctcctgaccatccccaagctgtccgtcgctgccctccgcttcaccgccactgctcgtgcccgcatcgagaaggctggtggcgagaccctcaccctggatcagcttgcactgcgtgcccctaccggtgccaacaccctgctcctccgtggccccaagaacgcccgcgaggctgtcaagcacttcggcttcggtccccactctcacaagaagccctacgttgcttccaaggggcggaagttcgagcgtgcccgtggtcgcagacgctccagggtttcanggtctaaanaccttgctgaggaatggggaangacatgaacccactggngcangncgcatatcctggtcgaanggatatnngg

SEQ ID NO: 270 - DNA, 658 bp, Aspergillus flavus; identical to SEQ ID NO: 269
  misc_feature (576)..(576): n is a, c, g, or t
  misc_feature (585)..(585): n is a, c, g, or t
  misc_feature (607)..(607): n is a, c, g, or t
  misc_feature (624)..(624): n is a, c, g, or t
  misc_feature (628)..(628): n is a, c, g, or t
  misc_feature (630)..(630): n is a, c, g, or t
  misc_feature (648)..(648): n is a, c, g, or t
  misc_feature (655)..(656): n is a, c, g, or t

SEQ ID NO: 271 - DNA, 1015 bp, Cryptococcus neoformans var.
atgaacacccttctccagcaagtacaacaaccgtcaaagctcgacacgctcgccgccgctgaagacgagtttgcccgctcagaccacgccgcctggggaagtatggccggcttcggtaacctttctcgaacagggagtgtttctggcatgagtgtgccccgagtgcacgatcctacttcgttccttgacatacataccgattcaatgtctgccaacccagaggccaagatcaagattgctcacggcacaacgactctcgctttccgcttcaagggaggtatcattgtcgccgtggattctagagctactgcagggagctatgttgcttccggcactgtcaagaaggttatcgaaatcaacaaattcctgctcggaaccatggccggtggtgcggcggattgtcaatactgggaaacgtatcttggcatgcagtgtcgactgcacgaattgaggaataaggaaaggatttctgttgcagctgcatccaagatcctttccaatatcgtctaccaatacaaagggatgggattgagtatggggaccatggtttgcggctgggacaagactggaccatgtatattctacgtcgacgatgatgggcaaagacttaaaggcgatctcttctctgttggttcgggtagtacttttgcctatggcgtgctcgaccagggctataaatgggatcttagtgacgaggaggctcaagagcttggacgacggtcgatcgttgctgctggtcacagagacgctttttctggtaatacctgtaacttataccacgtcagacaagagggctgggaatttattggcaactacgacatcaacgaactgtggtatgaatacgaagggaagaagaaggctgctcggcaagcggcagttggatctcccatggcggtggaagcttagacggtagaaggaatgtaatgcatgtatacataatcgtgttcgcatccatcccttgtacgtctttgggctgtctaggtcatcgaatggaaagatgtacttcatacttccc

SEQ ID NO: 272 - DNA, 1356 bp, Ustilago maydis
atggacccagccacgttcttgtctcagtacaccgatgttgactcttccaatccagccgccaagatcaagctcgcccatggcacgacgacgcttgctttccgcttccgtggcggtatcatcgtctgcgttgactcaagagccacagcaggatcctacattgcctctggtaccgtaaagaaggtcattgagatcaatccttatcttctcggaaccatggctggtggtgcagccgactgccagtactgggagacgtatctcggtattcagtgccgtctgcatgagctgcgcaacaaggaacgtatttcagttgccgcagctagcaagtatctgagtaatctcgtctacagctacaagggcatgggtctctcgatgggtaccatgatctgtggatgggataagaccggtcccgctctcttttacgtcgattcggatggtaatcgtctcaagggtgacgtgttcagtgtcggttccggttccacattcgcctatggtgttcttgatcagggctacaaatgggatctttcggatgaagaggcgcaggagcttggacgccgctccatctacgccgccgctcaccgagacgcttactcgggtaacaccgttaatctttaccacgtccgcgaaaatggatgggagttcatcgccaactacgacgtttccaagctgcattacgaaggacctggtgacaatgtacctggagcgccaggcggaggctatggctgggaggtgcgaacgcagggtctgtcatccaagctcgaagcacagccagggcacagcgtcagcggtcagggtggacgtttcgctgacgaacagcctctcgctgcccaagctcttggctacagacctcttcctaagtgtgatcggaacggtcgcctgaggcgcatggagtccgctcacgatttaccacatcctgcagtcatccgcatctggtgcgctgaagaagacgtttggcaccttgcattgagaatagggaagagctggcttgccgtgggcgacctgaggtcgttgcgtgttggaagtgagccctgctactatgctcaatctcctgccgctaggcgatctcgatcgaaaacggcatttacatatcatgaagctaagaaggtacgacaggatctgaaacttgtcgtcattgcgtcaggaggtctgtccaaaacctgctacagcgcacagcaaaggtgctgtctcgttcaaagatggaggtacagagacaagatgatgagcgcgatgcgcgcacagtcaacaaatgaggtttggctcaagtgtcacatgctggacaatcacgaatccatatatgacactcacgactctcaacagctttgtacatcgcctgcgtccttccgtggtcacgtcacctag

SEQ ID NO: 273 - DNA, 818 bp, Paracoccidioides brasiliensis
  misc_feature (818)..(818): n is a, c, g, or t
atcggcacgagggtaaaagtcagctttcgacaacggtatcaacagccatgggtatcgatttggaccgccaccatgtccggggttcccaccgcaaggcacccaagagtgataatgtctacctcctgcttctcgtgaagctgtatcgcttccttgcccgccgtaccgactccagcttcaacaaggttgtcctacgacgtcttttcatgtcccgtattaaccgccccccggtatctctttcccgaattgtgagcgccattgggaccaaggaaacagcagaagcgaacaagggaaagaccatcgttattgttggtactgtcaccgatgacaaccggctcctcaacgtcccaaagatttccgttgctgctcttcggttcacttccaccgccagagctagaattgagaaggccggcggtgaaaccttgactctggaccagctggccctcagatccccaactggtgccaacacattactgctgcggggtcccaagaacgcgagggaggctgtaaaacactttggcttcggcccacacagtggaaagaaaccatatgtccagagcaaaggtcggaaattcgagcgggctcgtggtcggagacggtcccgtggcttcaaggtttagggtgtttctatgggtcttgtcaggttcacaatcgctgaactgctgtgaatggcctcacatttctatcgatgatgaccctgtgatatgttcccttaaaaaaaaaaaaaaactcgggggcgaccatccttatgttttcaaccggcggtaagcgatggactgtccttcttgccctccggaaaagccaccagcaggaggttagtn

SEQ ID NO: 274 - DNA, 720 bp, Botryotinia fuckeliana
  misc_feature (684)..(684): n is a, c, g, or t
  misc_feature (702)..(702): n is a, c, g, or t
atatgttgatcctaccttcaatgaagcaagaatcaaggctcgtgatgaagcatacgcaagagctaaggctggtgccgatgaagagcacaaggagaccttgagacgaaaagaaaccatccaaaagagaaaggaggaagcttccgaaatccaatctcgcaaagagaaggaagaagccacaagaaaacgtatcaaggctgcacaactccaagaagctgaggacaagcgactccaagccgaacaaaagaagcgtgaggacgatcgtatcaaggctgaattggagcgtgtcagaaaagcagaacttcaaaagcaaattgatgacctcaagattggcaacaaggctcttgacatcgatcttgatgatttggacaaccttgacggcaacaaacttcgtgccatgaagttggctcaactcgagcgtgagaagaacgatacaaacgaaaagttaagaattaccggtaaacgtattgatcatctcgagagagctttcagaaaggaggaagccaagaagttgccagaagactatgaagcacaaagacagcgtgatttggccgcttatgagaagactaaggctcaaaccttgaaggatgccgaagccaaacacaaggaaaatgttgctctgaagcacagattgacaagattggtttctcattacgaatctttccgtgatgatattgccgagcgcangacatgagagtttgacanacgtcgtcgtgatgccga

SEQ ID NO: 275 - DNA, 1896 bp, Aspergillus nidulans FGSC A4
atggttgcgcctagggacacggcttttgccgaagaaagtgctgaagtggaggtgctgtacgccaaccttgagaagctcaagcgcctcacaaagaagatccaagggtcgctcgtacgcctcgaaacgggcggaaatgtcgtcaagcatgcaatcggacctatatatagcaacacacaatcgcttcagataacgaataataacatcgaccgggttattgaagccatcgaacgcctccggcagccactggatgcgaagaatcgagaagaaggggtcattcgggctgggccgcagccgaacaacttgccgcagtatctggcggcaatgagaggtgtgaacgatgcgttgatggacctcacctccacgaatttgaaatcaaatcagaaggctatcagcgagttcacgtctctattgggtattggcaactccaagttacaagatctgctgcgactgaaactgggcgagcatgtcagcccgattgagccgctgcactatttgaccaaggaccttccattcccaacgatcccggaagacaggattgcggaaattgcacctatctgtgcagcgataaattcggcagcagtacatgtcccgcatcgtggcgaaggtggcagccctgcccttaagatctacgctgatgttagaggcccgtatattagcacgagcgcgcaaaacctggccatcgcatctctcaatactctgaagcgaagagtagatgacgagtcgccatataagcaaggtactaatggtatcggaacctactccgatgccttggagaacttcatatacgccgaatgggaggccattaagcgaatttttacgggagaccatcggggactggctttgcaaatgacgtgccgctctgcgatcgcggaatattcaaaaactatacgggaactaaacgattatattcgtacgaacctcctcaccgactgctttttagctttcgagatcatcgacatcgtcacagccaagtcttacgatatagagttaaagacgggcgaactcaagagtttgttcctggaggcattgaggcctgtccgggagaccgccaaatattctctggcggagcttttggaagagacaaaacgtagggcacaggctattcccatgcttccaccaaatggcgctcccacccctcttgtcgataaggttatgcgctcccttatcgagcttacagggtaccagaagcctctggcttctatcttaacttcgctaggagacggaaattggcgttcaacctcagcatcatcaatgaatactcctttggatgtcaatccagacagtgatgtgctgttttcacatttcattctcgatgtgatagaaacgctgctgattgctttggaggctcgggctcgccaattgcaccggacaaaagctgctcagggtgtctttctttcaaacgtcttctgccttgtggaccgcgctatacgctcaagcccagaacttgcaagattcctcggttctccagatagcgtttctaggatcgacacgttccgcaagcgcgcaacgtcaacatacctggatgcttggaaggagacgtcgcattacctgctcgacgtccagtacacgtctcacactaggggtggcagtcgacctcaatcgggtggcgctgtcgattctagcgcgattgtcaagtcgttgtcatcccgtgacaaggacgcaattaaggacaagttcaaagccttcaatgcaagcttcgacgacctcgtggcgcgtcacaagtctttttatatggagcgggaagtacggagtgtgctcgctcgcgaggtgcaagcggtgctcgagccgctatatgcacggttctatgatcggtatcacgaactcgataaaggccgtggcaaatatacgaagtatgacaagggcagtctatctgcgcagcttgcatcgttgcaatga

SEQ ID NO: 276 - DNA, 889 bp, Aspergillus niger
gagcaagcctcctgagggcgtggtcttgccacccaaggatattcgagctatcgtcgagaaaacggctggctatgtcgctcgaaacggtgtcgtcttcgaagatcgcgttcgtgaaaaggaacggaacaaccccaaattctccttcctcaaccccggtgacgcctacgctcccttctaccaatggcgtctcgtcgagatcaaggaaggacgaggaaccgcagtggcagcaggccgaccaggagaagcgacccccgcagctgaaccagagaagcccaagggccccgaagaacccccggagtttcacttttctgcacggatgcccataatcaatgcgcaagatctggaagttgtgaagcttacagctctcttcgtcgccaagcgtggaaaatcattcatgactgcgctctcccaaagagaaaccagaaacttccagttcgacttcctgcgcccgcaacacagtctctaccagttcttcacccgactcgtcgaccaatacaccatcctcctccgctccgaaggcatcgacgccgccacaacagagaagaagcgtctcgccgaccttgagcgcaacgttcagaacaaattccacgttctcgaccgcgccaagcaacgcgccgaatggttgaaataccaagaacagcagaagcaaaagaaggaggaagaagaggaacaagagcgtatcgcatacgcccagattgactggcatgatttcgtcgtcgtcgaaaccgtcctcttcaccgaagcagacgaccaagtcgacctccctcccccaacctctctcaacgacctccaatccgcctccctcgaacaaaaagccatgatgtctctcaaccctctccgcatcgaagaagccctggcccaccgaaagaggaaactcccacctactaca

SEQ ID NO: 277 - DNA, 2289 bp, Aspergillus fumigatus
atggaccgcacaccgcttgctggagacaggtgcctggactctgatctcatcttctcttcgtctccagggtttggcactccggtacgccctttacgaaaatcaaatcttaatgctccggtcgcgaggagctcagtcttgccaattctacttccgccttctacgcttcgacctgtggctttccgtactttcaccaggaagcacaacttaaccatctcgtcctcagcactgcagactttggcttcctttgtggggaaacattgcggctctggatggcgcgaagaaggccttgcggagcgcgtcttggatgaggtagctaaaggctggaaaaaggccgggggtggcgtgatcgttgaggaagggagaggggcctcactgaaggctattttgaaggccttagagggcaacatgagtggaggaagggtagttgctgcgaaacccagtgcaataagagaaggaccgatagatgtgaatgcccccaattgtgatgccaggcgactgaacccgcacttgtctccagacccagcaatcaacaatgaggaacttgatgatttggacttatcattacacccaagaaattggataaagattgttgaggcattcgacatgccccgcttgacttacaacgtcgacaagaagtacttcgaattaacaaagtcaaaggctacattgttcccgcaggcttcacacaaaactagcatgtttagagaccgttataacatcattcaccagcgtctactccggaatgaaacatttcaatcatcgttgagttatctcacaggccactccatgaagaggtcgtcatcctcattcgctcccactcaatgttataggttgacaccgatcgcaaacttgcttggaagaagtggcacgtcacacctgcttctaggattactctctatatcacccgcaggtgatctatccttggtcgatttgacaggtagcgttgcgctagatctgagtcatgcccggacgataccagacgatggtgcttggtttgctcccggaatggtagtcctcgtcgatggagtctatgaagaggagggaagcgtgagaggatcagtcttaggcggaaacagcggagtcggtggcgccgttgggggtcgatttgtgggtgtatcaatttgcggacctccgtgcgaacgacgagaagtatcactgggaacaaatcaccagcacagcaacggagagattagctctagcggagggtttggatgggttgactttctaggaatcgggagtgaacgcgcgcaaggcccacgaatgaggagaatcaaagccaaatgtttgcaaggtttacgcgatgacgcggattcacccgtgcgactgaaagtggctatcatgagcgaggtcaaccttgacaactttaagtcgcttgacgcactgaggaaggttttcagtacatatagggagctttcactcaccgaacgcccaatagtctttatcgtgatagggaacttcgtccagaaggccacaatcaatggaggcggccatgctggcagcatcgagtacaaggagtactttgattcactctccattatactagccgactatcctgaacttttacaacactctactttcgtctttgttcctggagataacgatccatggtcgtccactttcacagcgggcgctgcctcgatagtaccacgtcagtcaattccggatatgtttacgtcgagggttaagcgtgcgtttgcatcggcaaattcggagtcgaggctatcgcaagcttccgagcctgcgggcgaagctatctggacctccaacccatcacgtctcaccgtttttgggcccttgcatgatatcgccatatttcgagacgacataacaggaaggctgaggcggaacgcagtggctactaagcaaggcgagaatgagcttgattctgcattttcacaagatgcgggagccgaggctggtcttgccactgctaataatgaaactgatgctcaggcctatccggcagatgccaaagctcggcagtctttttccagtgcgcacacggcacgaaaactcgtgaaaacaatactagaccagggaacgatgtccccatttccgcaatcgatgcgacctgtcttgtgggatcatgcatcatcgttgcaattgtacccgttgccgacagcgtttatcttggcggatcctgaagtggcaccattttgtatgacctatgaaggatgccatgtcatgaatccagggagattcatctctgaagaaggatcgacatgtatgagatgggttgagtatgatatattgaaaaatcgagggcgtgtgaaagaagagcggctgtag

SEQ ID NO: 278 - DNA, 889 bp, Aspergillus niger; identical to SEQ ID NO: 276

SEQ ID NO: 279 - DNA, 1740 bp, Aspergillus fumigatus
atgacatctgttgcagagggactatttaagtctttaccaaagccgaaatataccggcgaggatgaggaggtgcctcagcatgcccagccccgtggtccgcggatcgtgggcgccgaccagattgatcaaagtcagattgttttgaggagaaccggccctccaccatatggcaaccgtgcaggatggcgacctcgagcagctgaggatttcggcgacggtggcgcgttccccgagatcctggttgcgcagtatcctctcgacatgggccgcaagggtactgcgacgacatcgaacgcgctcgcggtgcaggttgacgcggagggcaaagtcaagtacgacgcgatcgcccgccggggtcacagtgagaaccgcatcgtccatgcttccttcaaggatctgattccgctccggcagcgggtggatatgggagaaatctcgctagaccgtccgtcggaggaagaggtccaggcgcagatggagaagaccaagaatgcgctggcgagcctggttgagggtgctgtggcggcgcagaagccgaagaacgtcaagggtggtcggagggcagagcctacgtttgtccggtacacgcctgccaaccagatgggagatactacgcggaagaacgatcggatcatgaagatcgtcgagaggcagcaggatcccatggagccgcccaagttcaagcacaagaagatcccccgcggcccgccctcgccacccccgcccattatgcattctccgcctcgaaagctgacggcagaagaccaggaggcctggcggattccacctcccgtatcgaattggaaaaatcccaagggttacacggtcccgctggacaaacgtctcgctgcggacggacggggactacaggatgttactatcaacgacaagttcgctcagtttgccgaggccctatttactgcggaccgacatgcccgtgaggaggtacggctgcgcgcacagatgcaacagaagctggcggagaaggagaaggctcagaaggaggagcatctccgcgccctggcgcagaaggctcgcgaggagcgagccgccagcaaccgtcgcgattctcgtgcgcggtcccacacgcgcagtgccagccgtagtccctctgcttactcgcggtctgccacgcccagcgatgacgaggaagcggcccgggagcgggagcgcattcgtcgcgagcgccgccaggacgccgagcgacagctgcgccagtctcgcatgggaacggaacgacggatccagatgatggcccgtgagcagaatcgtgatatctccgagaaggtcgcgctcgggttggccaagcccacccagacatccgagtccatgtgggactctcggctctttaaccagacaagtggcctgcagtccgggttcaacgaggataatccctacgataagccgttgtttgccgcgcaggacgcgatcaacagcatttaccggcctcgggctcagctggatgtggatgacgaagagggagctgaaggggagatgagcaaaattcagaaaaccaatcgcttcgaagttctgggcaaagccaaagaaggtttccgtggcgcagctgaggctgaggcccgtgacggccccgttcagtttgaaaaagacacgacagacccctttggcattgacagcatgatcgccgacgtaaccgggggagccggacagaaacgctacgggatccaggaagtcgaacgtgaggatcgggggtcgaagcgcgcaagagtcgatgatgattaa

SEQ ID NO: 280 - DNA, 4224 bp, Aspergillus fumigatus
atggagtcttgcagattagtccccgttggttccttaaacccatctgcctgggaccgtatcacacttgcattggtcctcactctattcatttcctgtagccctcacaagttcctgtgctacttctttaccttctgttacctctatgttcctcttattgtgactaaagcccaggcccaaagtatcatttccatgatggaggtcaaggcggcggaattggtggcggcgttgaagaattccaacatgtcggttgataccaaggttgcccatctccaatgcgtcaaatccgacatcaagcagaaaaatgtcccggagggggcagtcccatcgatttttgagtctattcgcctggcaattgcgtcccaacactcgtctctgtccggagccggcttctccacactcggtcattttctgaagcggctactcattcaggagctgcatcatttggtcgcactacaatgtcgcgctctgtatcctttgcttgtagagcgtctaggagatcataaagaacgtattcgtgctcaagctgcgcaatcctttaccgacatgtggctggcagcccccgaagaagtggagcaatgtgtgcttggacaggcgcttgttggcaaaaacccgagagccaaagagatgagtatgatctggttgtcgaatgtgagttcctcgttcaatattggtggcttttcttcatttctgaccattgccttgcagatgactaagaactacggtcttttgtttcgctcgtatgtgtcgagtctcgttgcatgtctggaggatgcagacagcaacgtgagaaatacggccaagaacactgttattgaactgtttgaaaatgcctctgaacgagccaagtccgatttgaaaagacaaatggctacccacaatgttagaaaatcttttgtcaatgcaattcttgcaagcatcgatcacggtacttccgatatggatgcggcctcacgacctatttcccgagctgaagccctcgttcatcgtcctgtgtctcgtgcggaaacacaagcttccagatcggtctcccggctggacacacatcaacgaccagcttccaggatggagctcgcacaatcctctgttttgcacacggaggctttgcctccccggccagtctccgtcttgtcttctcgttctgagactcacaaggaggttacaaaggaagtcattggggtggagcgccccaagagccgtcttactactgcaaaaagcgagccaaactgggctgttgtctctcacacgggccccgcggaggagttgcctctgccaagttctcgtcctgcttcacaagaaggtgagaagatcgacgccctttatgtttcatcgtcaagacaagtggacgaattgtttcgtgatatgatgccgcactttgaaggtcgggagtctgaggataactggatccgccgggaaaaagatgttctgaccctcaggcgcctcacccatggcaacgcgccagacgattattccccagcttatcttgccggtttgaaaaccttgctggacggcatattcaaagtggttaattcacttcgtacgactctctcgactatcggctgccttctcatccaagatattgctaagagatgcggtcctcggatcgactccatggtcgaaatcatgatgcagaatttgatcaaactctgcagcggtatgaaaaagattagtgcccaaaacggtaacgccacggtcgatgctctgatcgaaaatgtcactttcaccacgcgtattctgcagcacgtctccggagcttgtcaggataaaaatgtccagcttcgcctttttgcggccggttggctcaaaaccttgatccaaaagcaaagtcaccataagagttcgattgaacacggcggagggttggacatgatggagaaaagcgttaagaaatgccttgccgacgccaaccctggtgtgagagaggcgatgcgcagtactttctggacgtattaccgtgtgtggcccaacagagccaatgaaattctctcaaatcttgatcctaaatcccgttcattgctagaaaaggaccctgccaaccctaatgcgcaccaaagtgccccgaaggattctggcccctcgcgcaaggggctggcgaacggtacatcctctctcgcagggcgttctgctttgaaagaagcaattgccgcacagaagaaagctcggctcgcaccagcgaaagccgtgccacctcctcgccccgaatccgcgcagtcggccctatccgacaaacattcttcggctccatcctcttccaaatcatctgttcggacagtgccaacaggcacctctctatcttcactttcttccgcgcctgtgcgaccagcggcgaagcctcgccgacccgaactcaatcgtcccgcaactgcggacccatatgctgcacgccggtctgtcgcaaccgactccagcacaagacacggcaatcaaattgacggctctccaagcgcagccaagtcaaaatcttctacaccatctttgaaatcagttagcagcaccggatctcgtgacagggctgaccctgttggcacaaccagagatcggcccaaacgacttgttatctctaagacgcggtcccacgacacgcacaccagacagcattcaaaaccaatacccactcattcgagaaagaattcgaatgagagcattccccgtcactctccgcttcgtagcgaattttctgtgaccccgatttcaccgaacagtgtctcactggagacaccctctacgcctcgctcgcatcttgtccaggatcatggcaacttgattgctatcgcgtcgccacctacacacatacaacgtacaccgattgaaccggatgcaagtgcggaagatccccgagaacatgcagcaaaagcgacacctgtagccattttcgaagataccaccccagccagatctgatcacgatgatattcaagatgcagccatgacactgactgagaaccaaacccctcaaccctccaaggtacattctgattccccaattgtttctaacaagagggtaagcaatcaggatgaatctgtcccgcatcttactactggtttggggtttctgactggagtaggttctgtcgttgaagcatcggaactgccgaattccgacgctcaaacggatcagagcctcttcgcggaccattccttgccagtaactcatcaacccgactcagtcacagattcctcgaaaccgtctggactatcatcttctcttatggtggctgggtctccaatacgggtggccaacaatgaaaatgaaattgtcatcgactccaagacaacacacgtatctttgccacatcgatcttctccaaagcacaatgtcctcggagaacttacttcgaatgagccctcgcagcgggccaacaagcaaattcgacatgctgcgaacaaacttgaagatgaagtaacgacaccaattgacgaccattctcgtcatcgctggaagaaggtcgagatagcggatcggcggacgagtattagcccacgttccaaggatcccactaaggcgcaacagatgctcgacaaaggtattcaacgaattcgcacaaagactatggatattcttggatatcgcaagcttcaagggattatcaaataccatgattctatttttaccaatgaggagaaatacgatgaaatgttgttggcgctcttggacgaactggaaagttcgcctgacgacaagaggcaacccctcggccgacccctggacctgaagactcaggttctcctcacgatccgacttatgcttatccacaacaaaatctacttctcagcatactgttccagggctctgggtgccttagtgctcgctcgcaagtattatgatgccaattgtcatatcgtgagtggtttagaggaaacggccgatgatattattgccctttgcgagcctgctgctgttattgattctgttttggatgttatcattacggaggagaaagacgatcgcgagtatcggtcaatcctcatgggagttagtgtgttgactcggattctcagtcgtctgaatgccgacaagtgccgtgtaccggaactgcctttggaccgtctcggacagtttgctgccagcaagttagccgatcggcagcccgatgtgaggaggctcgcggttcaactatgtgtgcagttacacggaatggtcgccaacgaggaggaatactggcgagtattaggtcaccctcgggaaaattcccgaaacttgttgacttattatattctcaagaagtga

SEQ ID NO: 281 - DNA, 3195 bp, Gibberella zeae PH-1
atggagtctacggtcagcagccaagagaggaacgagttctttcaaaggctcaaaccatgctgcgtcaagataagtcaattggcgatacgacaagctgatgcaccagcttcatttcgagaactaagcgagcagacaaggctccttcatgaaactctcgacgaccaaatcagacggaatcctttaatgctggatgacaagttctctgaatatgtcttctttcctatccaccatgttttccgtcagatggaccaataccccatgcccttgatagaaaattgtatcaagacactcacgatccttatcacacatggctggaaagaaaaaatttctgcggagctcgtccggcagcttctaagtcttctcactttcatcattgatggaacgccttcatctggcccggcacgccctgttgctgaggagactgtattggaagcttttcgtgggttgacggccctcttcaatacagccggcttggcgaccaaagcagcctcaggactttccgaaactgagtcaatacctgctcttggacacggagtaacagtcatgttaaatggggtggttgatggtgccacgccgcagattcagcaggaagcattacgggctttgcaagctgtgtatcatgctgtgaaagagttggctgcgttggctagcttcctacccggcacgatctcctcactagcaaaagtctcatcatctcctaaccgatacaaagccatcgttctcgccaaatctttagagacggtaggccttgtgttgaccagtgtcatggctgatcttcggacacggtccatactagccaagactgaatctgaagatgaagatgaagtccacgataataagattctatcaccggcttggctcaaggcaagcactattcaaatcaagaaagcgcttgctgccatgatgaaattgcggtctcacgattcagtcgaggtcaagaacgctctcaacaagctttgcgtgattctcctcgacgaatgccacaaaacactatccaactgtgcaaacatactcgtcgagacagctatgatacttggagaaaccggacacaaagtgtctttgacgcggaccagtctacgagatctcatcagcatctatccggaacttggcgaaatcgccaagacaacaacatacaactggatgtccagtctttcacgattgatgcagtctgcagatgatgatgcaaagatagacgcgatacgaaatgtcatcaagggactcgagctcttgaaagagttgcacatacaatcatcgacacttgacgaatcgatgtcgatgatgctccgggatagtgtcatagccctgatacaagcatcaaagttaccggcgacgaatgagaacatggatgttcggctgatagatcaaggagaggcatcggcagattctgaagatacacaataccaaccagtcctgctccccgccgaatcccaaaagaagctccgaaacgagttatcatcgctcgttacatttctcggcacatcgccgcaacacgcaaggtttgcaggcaatatgttggaacaagttcaagattccgacaaccatgttggccaggttgctacgttttggctctgctttcagattgtgaaagcgagccacaaatcatctgccgaagaagacatgttttttaatctgtcgtcagtagcagatacatccttggatatcgacgccatatttaatgagctttacaccaattcagtgcagattcttgatcgacatacagatacagatccagttgactggcgctccgaagccttggctttagaagcaatcgcttatacggcacagaggtctggtgaatcgtttcgtcccgaactgatcgacgtactctttccagttgcaacatttctaggatccaagaatgtacagcttcaaaagcatgcgatcgctacgttgaacagtctggccgcctcctgtggatatgccaacgtgtcggaacttattatccggaatgttgattacatggtcaactcagtctccctgagactcaatagcttggacatatcacccgcgtcgatcaatgtactgaccatgatgatccgactggcaggtccccgtctggtgccctatctagacgacgtcgtcgactccattttcggagcccttgacaactaccacggctatcctctgtttgtagagaaccttttcatcgtgctcaaagaggttgtgaatcaaggtgttctttcagatatgttattgcttgaacatcaaacaaattcgagaccagaccacaggaaacaacacaagaaagtaccaggtctctccgatctcatgggtgtattggagaaaagaaagcagcgggcagtctctgaaaagatggaaatggataatgtgaaaggacacccgaagatgccgtggaaagagggcaaggatgaggaggtggcagaacctccccaagagccagagaaaccgcccaatacgcagacgtaccagctattgctgagagtggcaaacctcacacagcattaccttacatcgccgacaccaacgttgcgaagatcactgcttgagcttttaacaaatgtctccactgctttggcacccgatgaagaagcgtttttgccactggtcaattcgatctggcccgtcgtgatcgacaggttgcatgacccagaagcttatatcgcgatcgaagcttgccacgcgcttgctggactttgcgttgctgcgggggactttcttagctctcggttcaagaccgactgggctgactggcttcgcgattggtgcagcaaaattaaacaccaagcttccgcctcaccgagatgggccagaccccatggggaagctgacattacgtggggaagagaaagcgatgataaccgagtacttgtgcccctgaaaaatggtgacagtttaagcggcaagcctctaacgcgaatggtcacatcgtcttcaggtagcctggggaaatttgcgtcaccagtacgattatgggagggcacggtcgaactattgacagctctcgtgtcgcatgttcaagtggatgaggaaatgtttgacgacattctcgatctgcttgcgggggttttggagcagaacgttcaagttcgggaggcattggaggctgtcaacaaggacgctgtatggttatcacgatatgaacgagggaacgttgaatggctggcaaccccgaaaatggacggattgcaattcgctgccatggcaatgtctcaggaaagggcatccagtagctga

SEQ ID NO: 282 - DNA, 2423 bp, Cryptococcus neoformans var.
atgaacacccacctcgcagcccgtcttcagcacctcgcatcctcctacccgccgcacacagccctcttctacgcccgcatatggcacacactcgcgcccaccacagacagcaaccacgactccctgcatgcgctcgcgctcgctttcctccaagcagcagagccatactccgccatacacctcgtcagagaccacacaggcctcgacaacctcgatctggatctggaaatcaggtttgagaggacagacaaggtgtgtggcggctgtgccatgatcgttgctcgctgctgtgagaaactaggcaggtactcggagggacaggccgtcttggccagggcgttgaaaagaggtgccaatatcagtaggtttggttgcaacgttgatgagtaccccgtcctgacgcttgacagatttagcattgcctgcaccctcatcgaatgctgcaacggcatatctactcctggccaacctgtcacacaaaggaaagcgcttgatgaggatccttggatgtgggaagcctttactaatctctgtgacgtcggtaggttgaagtcttttgatgtttctctctttcagccaattcgggaactaacgaagcactcgcaaggtgccccaccccctatcgagtccctcttccccgcaggagcgggcctttctctctctaggcacgcctcacgatcgtcaaggcccccattgtcgccaaacattcatcgccagaaatcccctatagaaccggcacctggcgttctgaggcttcaccaagcccaagcaggtgctggcaatagtggtggattgtttacccccgacgtcgaaggaattggagggaaaacgggtcttggtatgatgggcaatccttcttcttgggactcgtcatccataataggcgacaccacttttgcggtcccggaacaaccgaccaagagaccattcccgtcgttcatgtcaactgcgaccagcttccttccatcgtctcttcgaggtggtacatcgaccccagcaggaagtgactctccacctaaattgcctactatgaaacgacccagaggcaaagatcctgtcaaaaggccagtggaaacaccccagtcacagatgagcagcggactacctcttgccaaagaattgaggccaaacggcgcaaagtacgaagactcggatgctccccgtcgtagctcgcggctcaaaacgacaacttctaaacctgcacccaaaattccccgcgatccgcacgccacgcgctctcgatcagtcacttcctccaactccaataacgaggtcccttctcctccctcgttgacatcgcaagatgcgattctacaaagggaagcggatgagtatctcaaggatatagtaaaaaaatgcgcaagggtttacaaaagtttaagccggtatcagtgccaacaggccatcaaggaggtggatgccttgcccggagagttgaagacatcaccatgggcaatggaaattctagggagggcgttttacgagattgccaactatgccatggcacggcgagcattcacgtttcttcaacagcaagaaccgtaccgcatccaatccatggagcagttatccacccttctctggcatctcaccgacctccctgcactttcacacctttctcaaagcttgatctcaatcagtcgttcctctcctcaggcttggatcgccgtggggaattgcttcagcttgcaaaaagaccatgatgaggctatgagatgttttaggagagcgacacaagtggatgaaggttgcgcttatgcgtggacactgtgtgggtatgaagcggtagagatggaagagtatgagagggctatggcgttctatcgaacggccatcagaacagacgcaagacattataatgcttggtatgggatgggactagtatatctcaaaacggatagaccgcgatatgcggagcatcactttagaagagccgtcgaaatcaacccgaccaatcccgtccttttatgttgtgttggcatggcgctggaaaagtcagacgatgtcgtgcaagctcttcacttttatgagcgtgcctccaaatacgcgcccacctccgcgatggtgcagttcaaacgcattcgtgcccttgtcgctcttcaacggtacgacgaggccatttcagcgcttgtacccctcacacacagtgcaccggacgaagcaaatgtctttttcttgctgggaaaatgtttactcaagaaggagagaagacaagaagctacagtggcatttacaaatgctcgggaactggaacccaaattggaaggcgtcatcaatgctgttttggccgcaaacggagaagagggagaggatgaggaatgaacggcagcgtacgcatagtgttttttttattaagttttacgaacctttacgtcagattcaagtattttgattacgtcctttgttcttaggctcacaaagga

SEQ ID NO: 283 - DNA, 671 bp, Verticillium dahliae
  misc_feature (576)..(576): n is a, c, g, or t
  misc_feature (579)..(579): n is a, c, g, or t
  misc_feature (588)..(588): n is a, c, g, or t
  misc_feature (614)..(614): n is a, c, g, or t
  misc_feature (641)..(641): n is a, c, g, or t
  misc_feature (669)..(669): n is a, c, g, or t
ggactggcaccaccgtgatgctgccgtctctgccttcggcgctattatggagggtccggacgagaagactctggatcccatagtcaagcaggcattgccgatcatgatcagcatgatggacgacagttcaccccaggtcaaggactcaacggcgtacgcacttggtcgcatcacggagagtatctctgatgccatcgatccggccacccaccttgaccctctcgtccgctctctgtttgctggtctcatgagcaacgcgaagatcgcctcgtcgtgctgttgggcactcatgaacctcgcagagcgcttctctggtgactacggtgcggagcagaacgccatgacccctcacttcaacaccagcgtcaccaacctcttggctctcactgcccgtcaggacgtggactcctacgtccgcgtcgctgcctacgaagtcctcaacacctttgtgcagcagtcagctaccgagagcctggctcctatcgcctctctctctggcgtgattctcgagcgtcttgagggctcaatccccatgcaattccaaggttgtcagtgtcgagggacaagatcatgctngangagatgcanacgagtcttttgcacagtgcttccanggccatcatcattcaagctttgacaanggagatcatttccccaagggccgaccgntt

SEQ ID NO: 284 - DNA, 760 bp, Leptosphaeria maculans
  misc_feature (14)..(14): n is a, c, g, or t
  misc_feature (17)..(17): n is a, c, g, or t
  misc_feature (32)..(32): n is a, c, g, or t
  misc_feature (739)..(739): n is a, c, g, or t
gactttcttttttnganaagaccccatgtttngagacgggcaccgcaaggtagccaagtccaccaacccctacgtcaagctgttggtgcgtctgtacaagtttttggctcgccgtaccgatgcccccttcaacaagaccgttctgcgacgtctcatgatgtccaagatcaaccgccctcccgtcagcctgtcccgcatcatcgcgactgctgccaacaagggatccgccaaggcacacgagggcaagacgatcgtcattgtcggcaccgttaccgacgacaaccgtcttctcgagctccccaagctctccattgccgctctccgcttcactgcctctgctcgcgcacgcatcctgaaggccggcggtgagaccctcaccatcgatgaggttgccactcgcttccccaccggatccaacaccctcctcctccgtggccccaagaacgcccgtgaggccgtcaagcacttcggctttggaccccactccaacaagaagccatacgtcgagagcaagggccgcaaatttgagcgcgctcgtggacgcagaaggtcgcgtggtttcaaggtgtaagcgtgtgctgcaaaaggcgcagtcgctgtttctttgggttgtcggcgtggtcatggtcatgggaatttacttacgaagcgtgcatcatgactggcacgggcttatcaagggtctgcaaaaggatactcagtatgcaattatgcaatggaagcaagcccatgtgctctnccgagctcatgaggtcaactc

SEQ ID NO: 285 - DNA, 2628 bp, Candida albicans
atgcattctactacaggaggaagaataggatcaagatcaggatcaacctcaacctcaaactcaaactcagcagctggaggaacaagagcgacgggagccacaacaacaacaaccacgtcatcatcaacagcaagaatattaggtcctactcttttccaagatgaaaccaattctaatcctaatcctaaatatattcaacaatatttaaggtcgattattattcattcattagatactttaaattatcaaaatgctgaatttgccagtgagagattattggctttaatggaacaaaaacgtgaacaacaactgcatcatcataatcattcacaaccacaatcacaaagagatgatgaaaatgatgaatttttagattcaatctatttatattgtcttgtattataccgacaagataaatataaaacttgttattataaattaagtaatttgaaaaaatttgatcatcatttaagttgttcatttctttatggtaaatgttgtttaaaattgaataaatttaaagaagggatatttcatttgattaaaactaaaaaatatcacgacataaatactagtactactaacaacaacaacacgtctaaattttctggtgcaaacacaagtaataatgatcgattcaataaattcaattatgaatataatcgaaacattaatcctgatatatcactgatttatcatatattgggtgatttatatcgtgagatcaatgatttgaaaaatagttgtatgaattatactttatgtttgaaattaaatcaatttgattttgaagcatttcaaaaattgtgtaaattgggagttaatattagagtcaaatcaattttcaaatttcaacaccaaccatatagtaaaaataatatcaataatgccttcacaaatgttaatgttaacactaatactaattcaaataatgaaggaccaacaatacctgatttaacaaatccatttactgatagatcattcaactcaaaattaactccatcaattcacgttgatgactttaatttttcaacaccaagagtgaaaactacaaataataataccagtataagttccgatgccgctttacgtaaatctaatttgaacaatggatcaacaacaaatgcaatctcaaacaatagtggaggtagtaccaataatccgagttctatcaatgctgcagtttcagtggcagcagcggcggcagcagcagcagcttcaactaccacgacaaacaataataacaacaatttagatttcgaatttaccaaacctagttaccccgatgataaaagaaaaagtcaaagcacttatttaagaataacatcaagattgatatcacagccacaatctctgcacaaccagcaccacaaccacaaccaccatcaacaacaacaacaacaacaacaacaaacaggatcatcgcagatggaaacacctaaaaaaagaaatttaaagcgtaataactcggctacgttagatccaatatatcatcagggcacttctgcatctaattccactacaaatgcaattccaggtataagtgcagcaacatcatcacctgcaacatcatcatctactgcttccgcatcatctctatcttcttcatcatcaattataattactaaagagattgaaaaaagtgaaaaacatcttttgcaattatatttaaatttaggtaagagttatcgaagtatgtgtaaatatgattgttacaaggcaataagaatgttagaaacgtcattgaatgaatttgaaaaaaatactccttgggttttaagtaaattgggaagattacattatgaaattgttaattatcctcaatcagaattgtatttcaccaaattgagaaaattggatcgaactcgtttacaagatatggaatattatctgacattattatggcatttgaataaaaaagttgaattgacttatttagccaatgaattacatgatttacaacccaatgctgccatcacttggtgtgtgataggtaatttgttttcattgattcatgaaccaaatgaatcaatcaaatgtttcaatagagcaatcaaattagataaaaaattcacttatgcttatacattaaaaggtcatgaatatttcagtaatgataattatgaaatggcattagaaaatttccgtattagtttattactagatcctcgtcattataatgccttgtatggattaggaatgatttatattaatcttggtgattatgaaaaagccgattatcatttccgtaaagcaatttccattaatccaatcaatataattctaatttgttgttgtggtatggtattggaaaaattgaataaacgaactttagctattaaacaatatgaattagctcataaattacaaccattaaatccattaccaatttttaaattgggtcaattatattttagtttgaaaaattatctgttagctttgaaaaattttgaaattttgaaaaatttagcacctaatgaagcaagtgttcatttcttattaggacaattgtataatttacaaaatgataaatttttggcaattaaagaatttaccgtggctttaaatttagatcctaaaggtaattatttaattcgtgaagctatggaatcattgaaaaagagttga

SEQ ID NO: 286 - DNA, 2631 bp, Candida albicans
atgcattctactacaggaggaagaataggatcaagatcaggatcaacctcaacctcaaactcaaactcagcagctggaggaacaggagcgacgggagctacaacaacaacaacaaccacgtcatcatcaacagcaagaatattaggtcctactcttttccaagatgaaaccaattctaatcctaatcctaaatatattcaacaatatttaaggtcgattattattcattcattagatactttaaattatcaaaatgctgaatttgccagtgagagattattggctttaatggaacaacaacgtgaacaacaactgcatcatcataatcattcacaaccacaatcacaaagagatgatgaaaatgatgaatttttagattcaatctatttatattgtcttgtattataccgacaagataaatataaaacttgttattataaattaagtaatttgaaaaaatttgatcatcatttaagttgttcatttctttatggtaaatgttgtttaaaattgaataaatttaaagaagggatatttcatttgattaaaactaaaaaatatcacgacataaatactagtactactaacaacaacaacacgtctaaattttctggtgcaaacacaagtaataatgatcgattcaataaattcaattatgaatataatcgaaacattaatcctgatatatcactgatttatcatatattgggtgatttatatcgtgagatcaatgatttgaaaaatagttgtatgaattatactttatgtttgaaattaaatcaatttgattttgaagcatttcaaaaattgtgtaaattgggagttaatattagagtcaaatcaattttcaaatttcaacaccaaccatatagtaaaaataatatcaataatgccttcacaaatgttaatgttaacactaatactaattcaaataatgaaggaccaacaatacctgatttaacaaatccatttactgatagatcattcaactcaaaattaactccatcaattcacgttgatgactttaatttttcaacaccaagagtgaaaactacaaataataataccagtataagttccgatgccgctttacgtaaatctaatttgaacaatggatcaacaacaaatgcaatctcaaacaatagtggaggtagtaccaataatccgagttctatcaatgctgcagtttcagtggcagcagcggcggcagcagcagcagcttcaactaccacgacaaacaataataacaacaatttagatttcgaatttaccaaacctagttaccccgatgataaaagaaaaagtcaaagcacttatttaagaataacatcaagattgatatcacagccacaatctctgcacaaccagcaccacaaccacaaccaccatcaacaacaacaacaacaacaacaacaaacaggatcatcgcagatggaaacacctaaaaaaagaaatttaaagcgtaataactcggctacgttagatccaatatatcatcagggcacttctgcatctaattccactacaaatgcaattccaggtataagtgcagcaacatcatcacctgcaacatcatcatctactgcttccgcatcatctctatcttcttcatcatcaattataattactaaagagattgaaaaaagtgaaaaacatcttttgcaattatatttaaatttaggtaagagttatcgaagtatgtgtaaatatgattgttacaaggcaataagaatgttagaaacgtcattgaatgaatttgaaaaaaatactccttgggttttaagtaaattgggaagattacattatgaaattgttaattatcctcaatcagaattgtatttcaccaaattgagaaaattggatcgaactcgtttacaagatatggaatattatctgacattattatggcatttgaataaaaaagttgaattgacttatttagccaatgaattacatgatttacaacccaatgctgccatcacttggtgtgtgataggtaatttgttttcattgattcatgaaccaaatgaatcaatcaaatgtttcaatagagcaatcaaattagataaaaaattcacttatgcttatacattaaaaggtcatgaatatttcagtaatgataattatgaaatggcattagaaaatttccgtattagtttattactagatcctcgtcattataatgccttgtatggattaggaatgatttatattaatcttggtgattatgaaaaagccgattatcatttccgtaaagcaatttccattaatccaatcaatataattctaatttgttgttgtggtatggtattggaaaaattgaataaacgaactttagctattaaacaatatgaattagctcataaattacaaccattaaatccattaccaatttttaaattgggtcaattatattttagtttgaaaaattatctgttagctttgaaaaattttgaaattttgaaaaatttagcacctaatgaagcaagtgttcatttcttattaggacaattgtataatttacaaaatgataaatttttggcaattaaagaatttaccgtggctttaaatttagatcctaaaggtaattatttaattcgtgaagctatggaatcattgaaaaagagttga

SEQ ID NO: 287 - DNA, 1533 bp, Aspergillus fumigatus
atggcttccaacgggaatactccaactcttccagatgaggtgaacaaacctccagagggtgtggttctgccacctaaagacattcgagaacgtgtgcgcgaaaaagagaaaaacaacccgaaattctcctttctgaaccccggggatgcttatgcgagcttttaccagtggcggttgaacgaaatcaaagaaggaagagggaccgcagtagcagcaggtcgtccaggcgagtcaacagcagctccagaaccagagaagcccaaggggcccgcacagccaccggaatttcacttttcggctcggatgcctatcatcaacgcacaggatctggaggtcgttaaacttacggcgctctatgttgcgaagaggggcaagtcatttatgaccgctctgtcgcagcgcgaagcgaggaactttcagttcgattttcttcgcccgcagcacagtctctatcaatttttcactcggctggtcgatcagtataccatcctgttaagagcagaaggaattgacgagtccacatcagaaaagcgcagaatcgccgaactggaaaacaatgtgaagaacaaattccatatcttggagcgggcgaaacagcgcgctgagtgggtgaagtaccaagagcaacagaaacagaagaaagaagaggaggaggagcaggagcgaatagcctatgcgcagatcgactggcatgacttcgtggtagtagagactgttctcttcactgaagcggacgatcaagccgacctacccccacctacatctctcaacgatctacaatccgcctctctggaacaaaaagctatgatgtcgctaaacccactgcgaatcgaagaagcgatgccaacagaccagggagcccaagtctactacaacgcctatcctccaacacaacccgagccggtggcacatcctgcccctccgtccgtttcaccatatcctcctcaagccccggtaccgcaaccctatcctatggcctctgccgccgcgcaggaagaagagcaacggattcgggagcggatggaggctcgagaacaggccgccgccgcacaagcagctgccaaagcgggccccggacagcagccgatgcgcattcgctccgactacgtaccgcgcgcacaagcgcgtcgtctcaatccttccggcgctactgcactctgccccaactgtcaccagcagatccctgtggctgaacttgaccagcacatgcgtatcgaactgcttgatccccggtggaaggagcagcgtgccaaggccgagtcgcgaagcgccaccacgaatctgtcgaccgccgatgtggtcaataatctgaaacggctggcgagccagcgaagcgacgtattcgattcatcactcaccgcaggtctcgatcctgaggaggaagcaaggaagaaaagaatggcctacgagaacccccctggagcggggcccacaccgccgatggttggtcctgcagggggcccgcccaaccctcagagtctaaacatcgaggagcagattcgacaaattcacgaacgttacaagcagggttag

SEQ ID NO: 288 - DNA, 660 bp, Botryotinia fuckeliana
  misc_feature (638)..(638): n is a, c, g, or t
cgacgacaaaccccccaaatcgccaatcatgggtatcgatcttgacaaccaccacgtgcgcaacactcaccgtaagacgccaaagagtgacaatgtctacctcaagttgttggtaaagctctaccgcttcttggctcgccgcactgaagcctccttcaacaaggtcgttctccgcagactttttatgtcccgtatcaacagacctcccgtttccatctccagaatcgcatcccaaaccaacaaggaggagaagagaaccgttgtcatcatcggaaccgtcactgatgacaaccgtcttttgtccgtcccaaaggtcagcgttgctgctctccgcttcactgctaccgcccgtgcccgcattcttgccgccggtggtgaggccttgaccttggatcaattggctctcagatccccaactggaagcaacaccgttctcctcagaggaccaaagaactccagagaggctgtcaagcatttcggtttcggaccccacaagcacaagaaaccatacgtcgagtccaagggacgcaagttcgagaaggctcgtggacgcagaaggtccagaggtttcaaggtctaaatggcctaattgggaaaggaacgttacgaacttctggctttgctggtctagatacctncaagaagggtggagggatgtca

SEQ ID NO: 289 - DNA, 650 bp, Mycosphaerella graminicola
accggactgccgttggcttctatcagcaagcaatgaagctgctcatcgtggtcgagcttctgatgggtgatatcccagagcgttccgtcttccgtcaacctgcactggaggccgctctgtacccatacttcaagctcgtccaggccgttcgcgtgggtgacttgcaggctttcctgaagtgcgtcaacgtcagcgaagctcagttccgcaaagatggcacctacaccttgatcctccgtcttcgccagaacgtcatcaagaccggcgtgcgcatgctgtcgttgtcatactctcgaatctccctacgagacatctgcacgcgcctcggagtggagtcagaagagtcggccgagtacatcaccgcaaaggctatccgcgatggagtgattgaggcttcgttggaccaccagaacggacacatggtgacggtaccacagaaggatgcatacagcacgaccgagccatcggaggcattccacgctcgtatatcggcattgttgggcatgagggacgagtgtgtgatggcgatgagataccccatgaacaagcatcgtcaggagattgctgagcgctgccaaggctcgcgaccgtgagcgcgagcttggccgaaggagattgtcgcatggccacatccacgaccgtgacgatga

SEQ ID NO: 290 - DNA, 583 bp, Aspergillus niger
ggaccgcatcaccttggaagagatgcagactagcattactagcgtggtacttgctgttgttcaacgactcgagaccgagatcaagccccaagccgaccgcatcatgcaggtgttgcttcagatcctggccactgttcctcctaagtccagtgtccccgatgttgtattcgccacgatcggtgccattgcgggcgctttggaggacgacttcatcaagtacatggacaactttgcccccttcctgtacaaggccctggagaaccaggaggagccgggtctctgctctatggccatcggcctggtcagcgacatctcgcgtgccttgaacgagcgggtgcagccctactgcgacggcttcatgaacgctcttctcacaatccttaggtcctcgaccaacgtgctgaagcctgcaatccttgagacattcggtgatattgctcaggctattggcacccagttcgacacctatctcaatgtcgttgcccaggttcttcaccaggcctctgttgtgaccgccagcaacgacgtaacccccgagatgcaagaatacattgtctcgctgcgtgagggtatcatggatgct

SEQ ID NO: 291 - DNA, 623 bp, Mycosphaerella graminicola
cggacgcgtgggcgccaacacaaccgccaaaatgggtatcgatctggatgttcatcaccaaaaatctgggcacagaaaagcgccccacagcaccaacccgtaccgcaagattctgcacaagctgtacgagttcttgaaccgccgcacggagagcaagttcaatgccaccgtcttgaggagactgcgcatgtcgcgcatcaacaccccaccgatgtcgctctccaagatcgtcgctgtctctgccaccgagcactccggcaaggagcacgagggcaagatccgcgccgttgttggaactgtcaccgacgacaaccgcatgctcgaggttcccaagctcagcatctgcgccctccgcttcactgcgactgcccgcgcccgcatcgaggccgccggtggtgaggccatcactttcgatcaactcgctctccgcgcaccaactggctcgaacgtcatcctcctccgtggaccaaagaacgcccgcgaggccgtcaagcacttcggcatgggaccacacaagaacaagaagccaaagatcgagtccaagggccgcaagttcgagaaggctcgtggtcgcagacggtcgaagggtttcaaggtttaaacgttgcattactgtgtggtat

SEQ ID NO: 292 - DNA, 1752 bp, Aspergillus nidulans FGSC A4
atgacatccattgcggagggactcttcaaatcgctaccgaaaccaaaatacacaggtgaagaagaggagttgccacagcatggccagcgaggaccgcgcatagtcgggccgggccagcttgacgatacacagattgttctccgaaggaccggtccgcctccgtacggcaaccgagcaggatggcgtcctcgagcgcccgaagatttcggcgacggtggcgcgttccccgagattctcgttgcgcagtaccccctagacatgggccggaagggaacgcaatcaaaatcgaatgcgcttgctgtgcaagtagacgcggaaggaaaggtcaagtatgacgctatcgcacgccgcggacacagcgacgaccggatcgtacacgcttcgttcaaggatttaatccctctccgacaacgggtggatatgggcgaggtatctctggacaggccgtcggaggaagaggttcaggcgcagatggagaagacaaaaaacgcgcttgctagcttggtgtcgggggctgtggctgcacagaagcctaagaacgtgaagggtggtagccgggcagagcccacgtttgtacgatacacgccggcaaatcaaatgggtgatacaagtcggaaaaatgatcggattatgaaaattgtcgagcgccagcaagaccctatggagcctccgaagttcaagcacaagaagatcccgcgtggaccaccgtcgcctcctccgccgattatgcactcgccgccgcgtaaactgacggcggaggatcaggaagcttggaagattccgcctcctgtgtcgaattggaagaatcctaagggttatacggtgccgttggacaagcggttggctgctgatggacgcgggctacaggatgtttcgattaatgataagtttgcgcagtttgcggaagcactatttacggctgatcgacatgcccgtgaggaggtccgactccgcgcccagatgcaacagaggttggcggagaaggagaaggcacagaaggaagagcatctccgtgctctagcccagaaggcacgcgaagagagaagcagagcgcagtctcgtgcctcacactccccaagccgcggccgtagccgtagccgcagctactccgatgcgtcatcgcgatcccgcacacccagcgaagacgaagaagccgcccgagagcgtgaacgcatccgtcgtgaacgacgtcaagacgccgaacgccagctccgtcaatcacgcatgggcaccgagcgacgtattcaagcaatggcccgcgaacaaaatcgcgacatttcagaaaaggtagccctcggtctagcaaagccaacgcagtcgtccgaaaccatgtgggattcccgcctcttcaaccagaccagcgggctgagcaccggattcaacgaagacaacccctacgacaagccgctgtttgccgcgcaggacgccataaacagcatctaccgtcccaagccgcaggccgactttgatgacgaggccgacgcggagggcgaaatgagcaagattcagaaatcgaaccgctttgaggtcctggggagggctaaggagggatttaggggtgctgcagatgcagaggaacgaagcggcccggtccagttcgaaaaggatacagccgacccctttggcatcgacagcatgattgcggatgtcactgggggtgctggcggagcaggtcaaaagcgctacggtatccaggaagctgagcctgattctaggggttcgaaacgggcgagggttgatgaagagaattag

SEQ ID NO: 293 - DNA, 2805 bp, Gibberella zeae PH-1
atggatatgatggaaaggcaacacgagaatgcttctgatgcagattctgacttggaggagttggaggatgatatcgccaaatttgaccagactgttaggaactttataaatgagcaacgcgacgaagttgtcccgccctcggcaaatcgctctggcctacgtgggaagggagctcgaggcccgcgaaaagcagccaaaccgagaggcgacatcacagcgcgactgtcaaaggtgaatcaggcttttctgagcggtgactactccctagcgctggaccttgtatttgaagtcatcagaatcaatgcagaaacacatcaagcatggacaaccttggcttccatctttggcgaacagggcgatatgagcaagtcgttatccgcaatggtttacgctgctcaccttcgccctaaagatgtcaacggatggctccgatgtgcatcattcgcattggagaatactagcgacgatgaggctgggaatctcaataccgcaagactttgttattctgccgcgctacgcgctgaccacacaaacctggacgcaagattaggcaagggtctggtctgtcacaggcaaggtcatcttgctgctgctatttccgactataaggttgtgttgaagcatcgtccttacgatcttgaaattgtcagaaagcttgcagaagcctgcgttgataacaaacaagcagaagcagctgttccgagcgcaatcgcagcctacaagcgtttctttgaccacgagaagaaagaaacgagcctcgagatgatagaatcaccgtggactgatatcggaatttacgtggagttgtttgcttcaaccggccgttatcaggatgccatccaagaggcgaaggcgctggctagatgggttctgggacgagagtccgaggggtactggaataactggcactccgatgaccgcgagtgggacatggatgatgaaagaagaacaggtgttccagaattcagagctgggctttggagcaccgacctctatggccggtcatttcctttggaccttcgtgcccgtctggcgatatacagatttcgacttggggatgaggaagaagccatgaaacacctgtggtggtttgatcctgagtccgtcattacgagagacttcgccaacgagtttcccttcttgacttttgatcttgcagaggaattggctcaccgtggtcacaccccattggcgatctcatactaccacgtacttcgcgacttacccggtgatgccgatgcaacaatccttctgcagctaggacgatgccattctgccattggcgagaatgcaaccgccgaggagtattttctggctgcgattgatgcggatgaagacaacattgacgcacgtatcgaactggccaacatgtatgaaaaagcaagagaggaagaagaggctcttatcctggcagctgaggcaatggctcttcgagagatccgggaccgggatcacaataatgaaagcggccaagactcaagcacggcaactgaacagcccagccgacgagctccacgacgaactcaagctgttcctcgtaggacagatgcttttggaaagcggcttattacgagacgctaccgaccaaaacgattggctggtgcagaaaagcgtcgacaagaggaacaggcgcgtgccgtaaagttggcggaacagtacgagattgtccaagatctccggcaaaagattaaagggggttgtcaagatttggttccagagtggatggcctcttcaaaagaacttgtggacgacttccgatcaatcaagaaattctatacttgggataagtatttacatttcttaggaccaaagaatcatacgcaacagcaagaagcaggccaaccacagaacgaactgtctcagatgtatgagagactagcgagaaccctcgcacctcaaccagacaacgggaacggagaagcaggttcttcagatctcgagagccatcggggtatttcattcaacaactggctcgatctatttcttgattatgccattggtctcgctatcgcacataggcgggacgaagcttatcaagtgtgtgaagctgctcgagattcaactgcattccaagctccggagcacgggtttatcattcatattgcttggagtgtttgtgctatttacacaagcgatgaggaaaagtgcatcgcaactgctcgccagcttatgagggatggtgcaacctctgattcgtaccgcatgtttgctctcgtatcaaacttatgccaatctcctgtgtcctggtacacatccggaccggcgcaaaagtacatcctccgtcagatcaaagccatggatgaagcctatggcgaaagtgagcccaacgaagattcagccaagaagagagagccatcgctggatgcttgtgtgctgatgctttacgggcatattctgtttacatcaacaagctacacatatgctctaggatactttctccgatctcgagccctggacccagacaatcccatggtgaatctaagccttggtctagcgtatgttcactatggattgaaacgccaatcaactaatcgccagtacctattgctgcaaggccagtcattcttgtcgcgttatgccgaactaggttcctcaagccctgtccaagacagtagtcaaaacaaggcagaggcgtactacaacttgggtcgcctttatcaacttcttggtataaactacctagctctagagtactactcgagagcaaagaaggtattgcagagtcacagggggcacgcagacgctcttggaggactcgagaacaacaaggcattgcctttgttaaaaggaaggatcaagctgtag

SEQ ID NO: 294 - DNA, 499 bp, Aspergillus niger
ccttgctcgcagccctgagaacagcagtgcttcgcaaggatgtggacacccaggctaccgtgatgacgctactcctgcgcaactacctatctacgtctcacatttcgcaggcagaccttctcatttcgcacaacaaattccccccatcggcatccaacaaccagattgcccggtacctttactacttgggtcgcatccgggccattcagttgcagtacaccgatgcccatggtcacttgatcggtgccactcgcaagtcgccttctagtcacagtgcgcgcggtttctaccaggcttctcataaattgctcgttgtggtggagctcctcatgggtgacattcccgaccgggccattttccgacagcccgcacttgagcgcgccatgcacccctacttcctccttgttcaagctgtgagtgtgggtgacttggacgggttcctcaacatcgtcaacacccacagtgcgacattccgcaggacgacgacactctgatctgc

SEQ ID NO: 295 - DNA, 2805 bp, Gibberella zeae PH-1; identical to SEQ ID NO: 293

SEQ ID NO: 296 - DNA, 400 bp, Blumeria graminis f. sp.
attaaaattgctcatggtacgacaacgctcgggtttaaatttaaaggaggaataattatcgcgaccgattcaagagctacagctggtagctggattgcaagtcagactgtcaagaaagtcattgaaatcaacaattgtctactgggtacaatggctggtggtgctgcggattgtcagtattggcttgcatatctgggtatgcaatgccgactccatgaattacgacataaacgccgaatttcagtagcagctgcttcaaaaattctagctaatcttgtttactcctacaaaggaatgggtctttctttgggtctatgtggcttggtgtaaccccatctgaaggacctgcactttattatattgattctgatggaacgcctttaagtggaaatctcttttt

SEQ ID NO: 297 - DNA, 2499 bp, Candida albicans
atgaaagattcacaatctgatataattgagctttgcaataaattaaatgaagcaacaaaactaaaacgtaatgggaaatcaatcaagctcaccaattttgtcagtaacactcaaatcaaattagattcttggaaatttttggaatgggattatggcaaaccttcggttcaacttccaattcaagcgcgtggattgtttacattaaataatgatactattgccgtaagaggatacgataaatttttcaatgttgaagaaaaaccattcacaaaagaaactaatttgaaaacctctactcatggaccctatgaagtcacattaaaagaaaatggatgcattatatttatcagtggattaagtacaggagatattgtggtttgttccaagcactctacgggagacagaattgatgataatgaaagtgacaagacaacaacggcaacggcaacggcaacggcgccgaccagaaatcatgccaaacaaggggaatttgaattattacaacaatttgatggcgatcaacaaaaagttaaacaactagcacattatttatatgaaaacaatctaacagttgttgctgagttatgtgatgatgagtttgaagagcatgtattgccttaccctaaagataaatcagggttgtacgttcatggattaaactataataccataacgtttaaaactttgccaatggatcaagttttgcaatttgccaaagagtgggggttcaaatacgtttcatacttaacatatgataatgctgacgaattattcaagttcttacacaagtgcagtgagacggggacatataatggtcgagaaattgaagggtttgtgataagatgtcaccgccaactgcataccaatggtgacactgacggggattgcttttttttcaagtataaatttgaacagccatatttgttgtatcgacaattcagagaggtgaccaaacaacttttaaatggtacacctatcaactcaatcaaaatcaagaaaaataagccaattaccaaaaagtatttacaatttgttgagaagttattcgaacaggaaccagaaattgctagaaattttgagaacggatttgatatcattaaagtgcgtcagttatttttgcaatcattaaacgaaactaatggtatgaatttgttgagtattgatagtgaattaagtgaccaattgaaaaatctagcattagctaatggtaacgaggggttgagtaccactaccaaatacatatttgttcctatcgccactattggttgcgggaagactaccgttttcaacacactaaacaaccttttcccacaatggacgcatattcaaaatgataacatttcgaaaaaggcaaaattaaaaatctgtgatttgactttattggcattagaggatgacgaccaaagtgtggttttgtttgatagaaacaattcggcatctcgtgaacgtagacaaatcttcactactattgatcaaaaaagagatgaacatttggatgatacagtggatttgaaatatattgctatcaattttatccctgaagatttatctgaagaagaactttgggatatcacttataatagagttattcaaagaggagataatcaccaatcgatcaaatcacaactggatgagaatttggtggaaagtgtcatgaaaggttttattcaaagatatcagccaataaatacttcaagatcccctgatgatcagtttgatcatgtcatacatttaaaattgtcaaaagatgagaattcgctgaagtcgtctttggagaatgttagaatcataattgatgatttggtgcaaaatttccccgatttgattaaagaaaaaccagctgatgaattaatcaatgagtgcttccaaaaagctcttgattataaacccacgtttgttaaaaacatgactgctaatactattaagaaagaccccacatattatggtattgctatgcattattcttcaattctagagaatttagaaatcgtttcccataatgaacattttcaaaatataaaatcacacattcaaacggaatttcatgtaacattgggtcatatagcaagcagtaaacaagataaagccggtcgagtcaaatggaaaaaacttgtcaagactttaggcaaaggtgatcccaataagccaaaatcagcgttgaaattttttgctgatgttaaattgcttcaaatagtaatcaacaccgataaattggcatgtattaaagttgaaatattgaaaatttacgatactaatgacgttctacaaagtgaaattgaaccaattaataaacaactccatattaccattggttgtatcccgccagctactgctgttgagtcaaacataacattggaagaattgtatgacaatccagatgaacaagaactcaaaccagatggaacttacaaatgtggtgacgatactttgcatgtatttaattttgacaacccagatttgaagttgtttagccaacaattgtttgttgcttaccaataa

SEQ ID NO: 298 - DNA, 585 bp, Candida glabrata
atggatattattctaggtataagagttcaggattctgtcatcttggctacctctaaggcggtaacgagaggtatttctgtgttaaaggatagcgatgacaagtccagattactatcgcctcacacactaatgactttcactggtgaagctggtgacaccgtccagtttgcagaatacatccaagccaacatgcaattatactctataagggaaaactacgagctttcgcccagtgctgtgtcaagctacgtcagacaggaactcgcaaaatccatcagatctaggaaaccataccaagtgaatgtcctaataggtggctatgatactaaaaaagagaagccagaactataccagatcgattacctaggtactaaggttgacttgccatacgcagcacatggatactccggattctacacattttcgttgctggatcaccattatagaccagatatgaccaccacagagggtctagaacttctgaaactatgtattgccgaattgcaaaagagaatgccaattgatttcaaaggtgttatagtcaagatagttgacaaggacggtgttagagaggttgaacaataa

SEQ ID NO: 299 - DNA, 408 bp, Aspergillus nidulans FGSC A4
atgcggaatgataccgagctgtccccgaatgccgtcgcgaactttgttcgaggagagctggcacgaagcctacgttcgcggaacccctacacagtcaatctccttttgggtggtgtagaccctatctctcagaaaccacacctttactggattgattatctcgcgtcattggccagtgttccatatgccgcccatggctatgctcagtactactgtctatcaacccttgacaagcaccatcaccccgacatcaccctggaacaaggcatgaagctgttagaaatgtgcacagatgagttgaagcggcggctgccgatcgattacaaaggggtcctggtcaaagtagtgaccaaggatggcgtgagggtggaggactttgacaataaccgaatcgtcaaaagtgcttag

SEQ ID NO: 300 - DNA, 2232 bp, Aspergillus nidulans FGSC A4
atgaatccagattctgtgccatcctcatcaccagggtttgggactcctgttcatcccttgcggtcaaacaaactcactcctattccgacaagaacgtctgtactgcccatcttactcccccccgccacactccgacctatcgcatttcgtacctttactaggaaacataatttgacgctatcttcttctgctctccaatctttagctggttttgtgggtaagcactgcggctcaggatggcgcgaagaaggtctcgcggagcgcgtgctcgatgaagtcgcgaagagttggaagaaggccggaggtggcgttatcatcgaggagggcagaggagcttctctgaaagctattcttgagacattggagggaaacatgagcggtggcaggttgattgattcgaaatctgcgtcaaaagaaggatctacgcgaactacaagcgctggcgggatgctcagcttacagccttccatgtcgatgatgacgacgattgatgaccaagaatcgaacaagtcagatgatacagtaatacaccctaggcattggattaaagtgattggggcatttgacactccgagactggcctacaatgcggagaaaaagaactttgaagtcacgaaaatcaaaccctctctatttccagaaccttcgcacaagaccgcgttatttagagatcgatataaccttgttcatcagcgtctgctgcgaaatgagttattccaagtgcctttagcgtctgcttctatgcctactttgcagcgatcttcatctacatttgcaagatcccagtgctacaagcttacgcctgttgcgaacctacttggaagaagtggtacatctcatttgttactcggtctactttctatatcccctacgggcgagctatctcttaccgatttgacgggaagtattgtcttagacctgagtcacgctcgtctcatccctaagggtggcgcctggcttacgccgggcatgtttgtactcgtcgatggcatttacgaggaggaggagaatgtcaggggctccacgctaggcggcaacagcgggattggaggtgcgataggaggtaagttcgttggagtgacaatttgtggtcctccttgtgaacgccgagaaacttcgcttggaatgagtatccacggtaaaaacgaggatatcagctctagtggcggctttggctgggtggacttcactggagtagggagtgagcgtgctcaaggttctcgaatgagacgaattcagacaaggtgtctgcacgaggctcacgatggtaatcagttgaatcgccgtttcaagattgtcatcatgggtgaagttaatcttgacaatatgaagacgatggacgctctgaggaaagtctttagtctatacaacgattcggctgtgcaggagcgtcctttgttgttcgtcttggttgggaattttgttcagaaagcaataattaatggcggtggtcagggcgggagcatcgagtacaaggaatgtttcgacatgcttgcattggtgttgtccgatttcccttcgttgctacagcggtctacgttcatctttgtgcctggagacaatgatccctggtcttcgagcttctcagcgggtgcttcatctacgataccacgctatgcaatcccaaacttatttacttccagagtgaaacgtgcatttgcatcggcaaattctcaaatggaccgaaatcaattgtcagagcctcccggggaggctatttggactaccaacccttcacgcatttctctgttcggcccggtccacgacattgctatacttcgggatgatatttccagtcgtttgagacgcaatgcagtgactgtcggtcataatactgcggatatgggaggtgatttgagcagcgctgttgaaccagaagatcaaattcatgctggagaccaacaaggagctggtatctccaaccaaacttcaccagtcactctctcggcccgaaaattgatcaagtcagtactggatcaaggcaccatgtctcctttccctcaatctgtacgccctatactatgggactatgcatcctctttacagctttatcctctaccgactgcttttattcttgccgaccccgagattgcacctttctgcttgacgtatgaaggttgccatgtgatgaaccctgcaaggttcatacccgaaggcggcttatccactatgacaactgaagagaatgccgaacggtgtgtagaagctgcagtggacgtttacaaagcgtag

SEQ ID NO: 301 - DNA, 647 bp, Aspergillus flavus
tcaggcggctcgagacggtttgagcatgggaacaatgttagcaggaatgacccctcaagaaggccccgctctctattacatcgactcagacggtacccgactcccgggcaacctgttctgtgttggatccggtcagacattcgcctacggtgtgctggatgctaactaccgttacgacttgactgaggaggaggcccttgagctcggccggagaagtatcctggccgctatgcaccgtgatgcctactctggtggtttcatcaacctgtaccacgttaaggaagagggatgggtgcaccacggcttcgacgacatgaacccgatcttctggaagacgaagttggagaagggcgaattctcgaatgttacgtcagagttgtaatgtgtggtggtgtcttagatggtttctcatggtggacatgatatatcaattttcttttcttaggcatacaagatacttccttctatgagtctgtttgacaagcagtaatgggaccgaagtctcattggtctcatttcaaaagagatcctttccttgtgttacagttactgggagagctcagctgtttgcactatggtacattctactaaaagagagataagtatgaagttgaaaagaaaacaatactataatgctatgatatact

SEQ ID NO: 302 - DNA, 591 bp, Candida albicans
atggatattattttaggaattaaagtatctgacggcacccttattgcaacatctaaagctgccacaagaggtatttcaattttaaaggatacagatgataaaacaagacatttaaatgcacacaacttaatagcatacactggtgaagctggtgatacggttcagtttgccgagtatgttcaagcaaacattcaattgtactcgatgagagaaaatgacattgagttatctccaaaggcaacagcctcgtttgtgagaaaccaattggccagttcccttagatctagaaaaccgtaccaggtgaactgtttaattggaggatatgatgtaaagaaaaatgagccatcgttgaattggatagattatttgggtacacaagttgaactcccttatggtgctcatggctacgctgcattttacacaacatctttgttagataaacattatagaaaggacatgacggtcgaagatggtttaaagttaatggatatgtgtgtcaaggaattacaaacgagaatgcctattgactttaaaggtgtgtacatcaaggtggtagataaagatggtataagacagattgagtcaaattga

SEQ ID NO: 303 - DNA, 8493 bp, Candida albicans
atgatagaaatacctgatttagatgagttatctctacataattattccgcatccaataacgttacaccagaagagaaccacagtgaagatgaaagtcaacaaccaccaccacaacaacaacaacaacaattcacacttcaaccacaacattccatccactcaccactgatagaggagaatggttatcttcaacaccaacaaaaccaattacatcagtatatgcaacaacaacaacacaatacactaaccccagagccgcctaccatctcagactttaccaaagatcaattgccgccatcggcaacttcttttcaaaactcgaccattggctcggatatactaggtgaaacaattgcattatacaacagtctggcgaatagcagtaatatacacaagtctcaaccacaactacctcaagaatcatcggaccatttgacgcagaaagagacatcaacagtatctgcatcatcacatccaatgttagatcaagcaccacaaatgatagacgctcgattagagagaatagagcatgaagtagacaacttcaatgagagggaaaacaactaccaacatccacaaatgcaaccatattcacaagatacagaatcaggattgtctctcggtaccgaagattcccaaaatatcagctcacaaaaagtggactatgttcaaacaaaaaattcctctttggaatttgatgcaccaataggactagtgtacatgcctgataatttggatgaacacaaaacatcatttaaattgcaacagccccccattgttacagattaccgtgacacaacaacaacaacaccagatttggccagcgaatccaatgatcaacttggccaactcgaaactccacttatggctggatttgatttcaacttgggaacaaatacttctctggcaaatcaattatcatcacccatgtcctcattcccacttcacaatcgcgtggagccatcaccgcaattaccccctccaatgtcttctgcgtctttacaaaaactcactttacgaaatggtgaagaatttggatctattagacgtgatttagcaactgattctaaaacttctgcggagtacacattgcacattattttcactcagtttgttcgtcatgccgaacgtaaactaaatttatgtcttgattatccattaaatgaggaaccacccattttagacttgattgcagaaggggtggatactgaatttgacaaaatcatttctgccttggggtacattgctcgaagaaaacccaaaccagttatcgatagtgtaatgttttggagaaaatccaaaagtgaagttgcttccatggcagcaacagaagtcgaaaaagctgtgggtgtggctcaaacgaatttacttagaatttccaaaacatcttcagcaacagcaactacaacaacatctccaattagcccatcaaacccaggaatagctaaaaatagcaacacggcttccactgccaagcgaagtttaagtttgatgagaaagaagagtttttcaagaatagcccatcgtcgaaatgtttcttcttcagcagcaattcagtcatcacagaacgtacctgaatcagaaagtgtattcatgaaacaaaaacaattctacgatgaccaaatttctcaagcaaaagaaactgctgtccacgctgatagaaaatcattagcatcaatttatatattatgtcgtgttttgattgaaattgtgaaacaaacaccattatcagtgatgggaagtgatctcagtagtaaattagaggaaatagtttacactcagttaaagactaccgatcctatcagtacaagtcagtcattggtacgtgctgcaaattggaatttatttgccgaactattaggatttatgtcgcgtgaaagatttgtcagtgtcaatgacagatttattgctgatctagagaaggtaccccaacaaattcgacacgaggatgagccgaagctctatttgttgatcaatgggatgaaatatctcaaacttacaatctatccactagaggaatttgaagaaagtgctgaattcatccaatcattagcaaaattttttgataaaacaacaaatgaaacagtcttatatgcgtattgtgaagttttcagtcagttatttttgccattggctaacgtcatgaccgcagaagctaattatccatcatgggtagaaggtgttgaaaaagtctactgcaaggcatttaaattgtggagacaatctttaggctcaaccagcagtccaacctcgttggcgttgccaaccctgaatacatctggggtatcatcaaataatggctggtctcattcattgattttaatggcatctgctttgtctgtgtcaagaaaggaattattttctgaagtttgggtcaatgtgatcaatgaaaatagcttcaaattgaaacccaaagttgaagctgaagataaaacgacctatatcatgagtattacaagactaatttgggtatatctcaatcgattaccagatactttgaataacacaattaaacgattggacgcaatttttgaattgttatttttccataataacgctaccagtaagaaaaatcagtggatatcaccagacttgtttttaattggatctttaattgaattaatcagaatagtgggttacaatcacttaaactatgtgttggagcaagtcttgattagacttttgaatatgagtttcaatggcacatcattggaaaatgcattccctgaaaaactcataattgttatcaaaagttatcttgctattttgaaagactatgaaattggtgacaaacctagttttccagcagattttcccaacgaacaaaagaaaaaagttaatgagtttttattcatttcgaagaacagtaccaacctggctgctcatgaggaaatatgccgtactttagtattgttgttaaagattttagatagtcaatatgggtcaggatttaataatgaaagcaattctttattttcattaggttcaagtaaatctcaatcttcatttgggtttcatttcaactacgatcctacaccccaaactactaaagaagttcacatacaattgtttgccactgttatcgaagccattccatggggaattgtaggagcatctggcgataatagtcagaatttgattccttttaaacaagttgttgatatattgattagaggggcaatccatccagattcacgtatctcaatggcctccatcaaatcattgaagtatttggcttctaaaaagaaccccacttccttgatgactatttatgccaagcttgcgttccatttttctgacaaaactggcccaacttatgatacacaatatttatactcagaccaattcaccaaattattaaagttgtacaccgaattattagattgctggttgattctgttccaagatttacttgaaaagaaaaaagcagaccagtccataggtgtgttagctggaaatgacaaactgaataacagagatgctttaaacaacttgtataagatcaatcgaaaaaatgccgatttatcagattctcaccccacaagattaaaccctagcgatgaatttgaatggaaaacaataatcactgccatcgaagatatcgaaggaaacgggttgtttttcctttgctctcaaaatccaaaaacgagatattatgggattaaagttcttaagttggttgaacagtttgatcaagcagtttataatgtaactgattcagctactgatactagttcgggaacgaagcaacattctagaagctcgtcaaaatttgctgccgacgttgggacaagacttattcatattttggaagatcttgattttgttgaattgattcaaccttaccgcaaagagctaagcgttccagaacgtacaagattaacaaaactcaaaaataaaaagaacattttgatccgattagcagagtcagattacggtatagactctgcaatttggctacgcttatatccaaaagtgctagagatattttttgacagatgtcctatgccagtagcaatgtgtcgtaatcttgtttgtgtttgtttggttcaaatgcatgagtttgtattggagttttctgatagctataaatcatacacatcgtctttattttccaagtcagccacaaacgtgccccccgaggtattggtcaatcaatggaaattatatctcatatttgcttgctccacattgactgccactaacgatcagaagatatcatttcccaatcaaccgacccacgggcgtaaaaagtctttgcagatgtttattcaacatcaaaaaattaccagtgcaaaatcggtatttaaaatggtattacccttattaaagctgtcacagccaatggtaaaagaatctgtcatagtggggttgagtcacataaatatcaatattttgaaaagctttttggagaatatcccattggcagtagaggaatggaacaccaatatgaaaacccgcaatcctcaagatgatgcgttcagaattgaagtggttcatatattaaccaatttgacggagaagtttggtctgcacgaattgatatatactgatgattcgattgtggccaacttagtagccattgttaaaaatgtgaagaattttttgtctgaaccagcaatacagactaattttgagtgccaaagattgcgtcgttacttttgtggattcttagaaaatgtctatactgggcttgaagcaaaatcagacttggaaaaatggctaccatttgaagcgagagtagcttgttttaattatctcaaggaatggtgtggatatggtgatagcagtgctgttactgaggaacgatataacgctataatcagtagaattaaaaccgaaaaggctgggccatcggcacttgccatacttgaaattgaacggaaaaaattacaattagcatcattaaaatgtatggcaattttatgttcgggtcaaatcaaaaagaaaatagaaataccaggaaacttggcagttgtctcatttgacattccaggtttgatgaattggattcaagcgttattagaatcgaacattgaaaaaataaaggaaattggtcattgcgcttcaaggaatgttattgaaaaaaactttgaatttcaagacattattagcgctgttgttcaaagatgctatgttagtcaaacttctttggaaagttacttttgcttatttgttgagatatttatggagaaaaacacttttgaaatggttccagatgaacttctctgtttggcttcagtattgacagcaaatgagagtttccaagtgagaaaatccgcaattgctttactcaagtatttcgaaaagaagagtcttgggtctgaatcattagaacgatacactgaagccatttgcagtaagagttcagttgtctacaaaaaagttttatttgatctttcgaacgatgtccaaaatataaaaccagaaagtttgtacaatagaatcagttacttgacgcagaatattaatttcatatttcctgctgcaagagaagctattttgtcattattagtgcccatggtctcaaaggttatattaaactacgagacccctttacctgaaaaggacagtaccacagacatccatgaaaaagcattcgatagctcgtcattaatggtgttgagcaatctttttgaaattacggtaaattttggatctaatatgtccaatcaggtagaagtattgtggatatccttgagcaacaatgttcaaaatattgacaaaattgtggaattcttattacaaagtagtcttgaactgaaaaatccatcatttgtcgagcagtcaagacaaatcattgattatttggcgtttgcaagatctgacccagcctatattattgataaattaattaacaatttgcaacctagaatgatggttccacctcaactaggcaataaatcaacagctcctatcagtaaagattatccctatgtatgcgatatcaaaaaaattattcaaacaaatgaaaaggatgtcatattttcattaggccaattaagcatggtatttttggttgatatagtaacactcaaaaatgatttaatgatagagaaactccctttgttattgcatgtgtcactttccttgatggatcactatttgccaattgttcaagaacaggcaggaacttttttagtccatttaattcatgcattagttcgtgatgacccaaaggcacaagaaacaattctgtcacttcgagaaaacgatcatatcaaacatttatgggtatatgacgatttaaacaacgacaaaaagggtgctagaacaccaaaaaatatggatttgttgataagaagtgctataaaaatgtttgctgccgttgctccaaatatacaagatgattggagtagagtgtcattgcattgggctactacttgtgctgttagacatattgcttgtagatcatttcaagtattccgatcattattgtcgtttttggaccagtcaatgttgaaagatatgttacatcgtttgtccaacaccatatccgatgaaactgttgatattcagggatttgcaatgcaaatattgatgactttaaacgctataacagctgaacttgactcagaaaagttgattgattttcctcagttgttttggtctagtgttgcatgtctcagtaccatccacgaacaagaattcattgaagttttgtcgactttgaacaaattcatttccaagatcgatttggatgcagccgataccgttgcttgtttgacaaaaacatttccacaaaagtgggaaggtaaatttgagggattgcaacaggttattttggtagggttgcgttcatcaacctcttgggaaccaaccttgaaattccttgataaattgattgttcataaggacagtttgattattggaatgggtgactccagagtattgactgcattattggcaaatatgcctcggtttttacatcatttgagtgaagagaatgtgacaccagaaattgaaaacacggctatggctttaagccagttggcagaggatagtggtaaatcgtcactagcaaaacttttggtttcatttgctaaaagacggtttagatccaagtctgattttcttgatcaatctatttcgtgtatcaagaatgcatttttcccagagtatcaggcacaaacattggtattgcttttagggttgttgttcaataaaatgccttgggtgaaaacagaaacattaggccttttgcaactgattttcccattagttgatcttcaaagagatgaatttattggtgttggagctgacttgatatccccattattgaggttgttgctcacagattatgccgaatgggcgttgcaagtgctagatgaagctgaaatcattcctggatcccaatcagataaggatattttgagaatgagtttaggaagcacttccatgaagaaggaatatgagaataccgctactttatttgggataccagatgagagtggttggtcaattccaatgccggcaataactgcagcaacgacaagaaataacgtacacgctgttttctcaacgtgtacgctcgataatattgttgatgaaaatgtggaacaagaagaagatgggattgatattcaatttcatctggaagattattatggaccagcaagtgatcaaactcaatttgttgatagtgtatctgttagtgtcgacgaacgagaagcgctgttaagtaatgtttgggctgccttggacgattttgactcgtttttcaccaaagaatccgagcaagctggaagtataccagtagtagctaatagagccatgagaagaagccacgcgcatcctcgacaccatgtgcatagtgcttcagttgacaccaaatacagtaattcaagtgacactttgatgcctatggaatcagcaccaaacgtttatgacaagaaggcttcggttattttgaatagaagtttggccagaacaacatcaaacacatcatttagagcaaatttggctgattccattggcagcacacaaatagccaccaactcaaaccattccaacaaacggtcatacataccattcagaagtagtaggcatggtaataaggctagagcagaagtattctccaccccaaaaatacctttatcagcaggatttgatgccaatgatcttgatcaaacaccctcttcaattcagtctacggcaatttcttcaccaacaataagtgttgcgcgcaatgatggagaccatgaacttgcttccaatgcaaatgaaaatgttaccagatttgaaggtatattgggtacaaagaaaagatccaaaaagggtattagacaaaactctccgaacgagtcaactacaaatatatcaccggacttaacagcaaataacagttttagaaactctcatgtttcttcaattgcctctcccaagggagctgcagctgttattagttctccaatacaggttgtgggatcaaataccgctgttactccaaattctggcaaagaaaagaaaagaatatctcaaaagtttcgctaa

SEQ ID NO: 304 - DNA, 576 bp, Mycosphaerella graminicola
ctgtctccgactccatcgacccggccgagcatcttcaaccactcattaccgctctcttccaaggattggcatcacacccaaagatggccagctcttgctgctgggcgttgatgaaccttgcggatcgattcgctggtgagcccggctgccagaccaatgccttgtcgcagcacttccaagctagcgtgcagcatctcctccagctgaccgagagcaccaacgagaacaccctccgcacggctgcgtacgaagtcctcaacgcctttctcaccaatgccgcaaatgactctgtccagatggtcgccagcttgagcgatgtcatcatcgagcgtctcgagaagaccattccattgttgactcaagtcgtctccgtcgaggaccgcctcacgctggatgagatgcagacttccctcgcatccgtcatcatggccgtggtacagcgtttggagcacgaagtcgcgcctcaagcggatcgtatcatgactctcatgcttggccttctccaaactctgccacccaagtcgtcagtcccaaacaccatctttgccacaattggatctctgggccaatgcactc

SEQ ID NO: 305 - DNA, 662 bp, Verticillium dahliae
  misc_feature (650)..(650): n is a, c, g, or t
  misc_feature (653)..(653): n is a, c, g, or t
aggacaaccaccacccatcgacttagttccggacatcgcgaagtcgacgacaagatgggcattgatctcaaccgtcaccacgtgcgcggcactcaccgcacggctcccaagagccagaacgtgtacctgaagcttctcgtcaagctgtaccgcttcctggcccgccgtaccgatgccaacttcaacaaggtcgtcctccgccgcctgttcacgtcccgcatcaaccgccctcccgtctccctgtcccgcattgcggccaacatcaaggaggatgagaagcgcaccgtcgttgttgtcggcaccatcaccgacgacaaccgtctcctgacggtccccaaggtgaccatcgccgcctgcgattcaccgccaccgccgtgcccgtctggctgcagccggcggcgaggccatcaccctcgaccagcttgccctccgctcccccaccggcggcaacaccctgctgctccgcggccccaagaacgcccgtgaggccgtcaagcacttcggtttcggcccccacagccacaagaagccctacgtcgctcaagggccgaagttcgagcgtgccgtggtcgcagacgctccaagggtttcaaggtgtaaagcgggttttacaacggaattggacgatctgggtctggttgcgggttggnttntcgcgttct

SEQ ID NO: 306 - DNA, 462 bp, Fusarium sporotrichioides
ctggaccttgaagaagctgaacaactaccttgaccaactcctccacaacaacacatctaatacttcccccaccacagaccacactatcgccaacatggagatacttttgggaatcactggaaaggacttcactatcatcgcagcatccaaggctgcgatgcgaggcgccaccatcctcaaggcatccgatgacaagaccagagctctcaacaagcacaccctgctcgcattctctggagaggccggtgacacagtgcaattcgccgaatacattcaacgaaatgcccagctctactcgatgcgaaacgagtccgacctatccccctctgctcttgcccactttgtccgtggtgagctagccaccagcttgcgatcccgaaagccttacaatgtcaacctgcttatgggtggtgttgatcctattactggcaagccatccctctactggctcgactacctagc

SEQ ID NO: 307 - DNA, 600 bp, Botryotinia fuckeliana
aaacgaagagatgaagaacgaaaattacgacagtcgcgcatggggacagagaggaggattcaaatgatggcaagagagcagaatcgagatatctcagaaaaggttgctctaggcttggcaaaacctacacaatcaaccgaaactatgtttgattccagattattcaaccggacaagtggatttgatagtggattcaacgaggatcaagcctatgacaaacctctttttgcagcccaagatgctattagtagcatttatcgaccacggcaaaatatggatgacgacgatgatgaagcagcagctgaaggtgagatggcgaagattcagaaaagtaataggtttgcggatgcgctaggaaagggaacctttcaaggtgcagcagatgttgaggcgagagagggtccagtgcagtttgaaaaggatgctggcggatgtttcaatgtcgatgattttctgagcaaggtcggtgagagttctaataaaagagagtatgggttacaggaaagcgagggaaggtccaacaaacgggcgagagtagatgaggacgataattaaatagatagacaatcatgggaatgcatggacagcgttgtatttata

SEQ ID NO: 308 - DNA, 3090 bp, Ustilago maydis
atgtctgcgaacggcgattctactggagaggcagatgccgcttcggccgtcaaggtgccgaacagcccatcgaccgcgtttgctgcgctgtcgctgtgcgaccaaccgtcgtcgtcctcttcaccccagtgctcgacgtcatccgcgccgttcactccagcacacatcaaagagatcgcatcctcaaccgcgctcgtagcacaactcgatgcggctcgaaagagacccaaaccactcattcggtccacgggccacatcgtcgagcgtactgattcgcacgtcaattcaaatgacgctgatcaccaccatctactttcatggaaagttgccgaattcgcctaccgaaagaccacatcgataggatcggaactccccactcttgcacgtggcctcttcacagagcgtatcggctgctcgtctgcagccgaaaagcaccgcatcgtagtacgaggctacgacaagttcttcaacctcggcgagatggcgtggacgaaacctgaatcgatctcgcgctacaccaccgcaccatacgttctcacattcaaggaaaacggctgcatcatctttgtctctgcgctttcgcctgatgagcttgtggtgacctcgaagcattcgctaggctcgatcgaaggtgccgacattacgcatgcacagaagggacacgaatggctgctctaccacctggcctcggtaaagcgaaccgagcaacagctcgcgcacgagctgtggcgacgcaatgagactgcagcattcgagctgtgcgatgactcgttcgaagagcacgtacttgcgtactcggccgcaagatccggattgcacctgcacgggctgaatgccaactcgcccgaattccgcacgcgcaccatgccggaagtggatgagttcgcgaacgagtggggattcatcccaacacgctggctgcagctggacagcttggaccaagtgcagagcgttacaagcaggatcgagcagacgggtgcatgggagggtgagccaatcgaaggtttcgtcatccgcacccacatgcccgacgccaaagcgatgcaaagcttggctgaaacaaacgtggtcagcccaccgtatgcgcctggacaagcttggttctacaaagtcaagttcgacgagccgtacctcatgtaccgagactggagggaactggcacgcaagatggtcaaggacaaagctgagtgggagacgaaagttgcgagcttgcctgcagcatgtacaggtcatgattcgctcgacgaggccgctccgtcacttacgattgtgcaagccgaatcgtccgcctcgataccggacaacaacgttgctcacctcggcgatgcggatgattcggacgccaaaggctcgtcgaaagcagcgatcaaacgagcacgaaagcggctcgccaagcagacggccaagcaagcggccgcgcatcgcaccgccgcacaagcagctggtctactacctccttcgcccccgcaaccgcgctccaaacgacccgaaaccgctctcttcatccaatggtgctacgaccgactttacggcaacgccgctgcacaggtcaaacctcaacctcagctcttcgccggtctggcgcagaacaagggtatcattgcgatgcgaaatgcattcctggcttaccttgctgctcatcacgcgtccactagtccaagtacaagcgctgatgaggctgccagagacgcggagcaagacactcgcccgtatacgaaaaccatccttgcaccgatcgccgtacccgggtgtggaaagacagtgctggccgtagctctgtcgtcgctcttcaatgtcggacacgtgcaatcggacgactttaagaagaagacgggcttcttgtcggcgatcgaaaagcatgtgcgtgcgcacgctgccgatgccaactacgtcgtgttcgcagacaagaacaaccatcttttgcaacaccgtgacgaggtgatccaacttggagcgcgactttcgcaaccagctgcactaccgacaggcaagaagcgcaggcaggtggccgacgtcggtcgcgttcggaccgtggcactagcatgggagctggacacggtgccgctgaacacgctgcaccgcatctgtgcgagccggatcgaagcacgaggggataaccaccagacgctggtcgccgatgcggacgcggcgagtgtgagtggcttaaaatcgcacgaggtggtgctctggaggttcttggaggcgctgcagccgtttgcgagcagcgacgcgaagggagagggggacgaagggtatggcgatgcgaggtttgacgaggtgatcaggttgggtgttgacatgtcggtcgaggaaaatctgaggagggtggtcaacgcgatggcggacaaggtgggatgggagatgccgagcgacgagaggttgagggatgccttggatttggcggcaaggtggaaggtggagaacaagttgataagcaagtctgttcctggcagtggcgcggatgcgtcgaaatcgagcacagacgcaaccatgattacgcctcggtactttggattggcagttgagctggatgtgcgacaactgctcgattccatgctgctcaccaccgatgcggtagacgagggcatcttgcgcttctacacaagcatgcgcgatagtaaccgtctcaaccgacgtccgcacatcacgctcgttcaccactcgagtcgatccgccccctccaccagctcgcccaacaacgccgatgaaaaatggtccttctacaccacgctcctctcacaaccgctagaccacgcctcatccacatcgtcgcccaccggcgcacatctagtattcaacgtatccatcagtaatctgctctacgaacccgacacattattcacgctccccgtagaccagatcactccgcccgacataatccactcgcgctttcaccacctccactatcccccccctccatccccaccctggacaccacatatcaccctagctacccatcccaacatcccaccctacgaggctaaccgactcgtctcccaatggatctcaaacacccaccacgcaaacgtccaagtcctcaacctacctacccaacttaccgtccaagctagggttttcgccatgtcctga

SEQ ID NO: 309 - DNA, 507 bp, Fusarium sporotrichioides
caggctctacaggaggctgaggatctgcgacttcaaaatgagcaaaaggagcgcgaggccaagcgactcaaggctgagcgtgaccgtgtccgtaaggaggagctcaagaagcagattgctgatctcaagatgggtgacaaggctatcgatatcgatctggaggaccttgacaaccttgacagcaaccgcctacgtgctatgaagcttgctcagttggagcgtgagaagaacgatgtcaacgagcgtctccgcatcactggtaagcgcctcgatcatcttgaacgtgctttccgtaaggaggaatccaagaagctgtaggaggactatgccaagcaagttgaggaagaccgcaagatctacaaccagatgaagacccagaagcttgaggaggctgagctgaaacataaggagagcgttgagctcaagcaccgactcagccgactggtgcctcagtacgaggagttccgtgactccctgcatgagcgccgccgtgacgagttcgagaag

SEQ ID NO: 310 - DNA, 2924 bp, Cryptococcus neoformans var.
ccacagggctatcatcatgccccccatctacgtcaagccagagaacgccctcaagcgctcagaggagctcctggctctcggcacaccccaatctcagcagcaagcctttgacaacctcgtcgaggtcttccagtcgaaacgattcaagcagactcccatcaacgtccttgaacccatcgttaccaagttcattgatctctgtgtagttctcagccgcaaggctcatgccaaatccggtctcctcgttttcaagtctgctgcccagaccaccaatgtcggtgccatcgaaagggtattgaaccactttattgccaaggccgaggcccgtcttgctgcggccgtcgagcaggccaagaaagaggttgctgctttgcccgatgttcccgttgtggacgacgacctgccccttcaaccggcttcccttatgcttgactgctttgttgacagtgctggcgacagggaaaggattgagcgaagattgattgcccccgcccaaaagttctgctgggattcttacgacatttgtctcgatattgccaaaagcaacgacaggctcgaggttatctaccaatctatcgcccaccgtgctttccatttctgcaagattcaccagcgcaaggccgatttccgccgtttgtgcgaacaacgattgcgaaaggatcttgccaacgctgccaagtacagccaccagcaacacgccattaacctttccgaccccgagactctcggccgtttccttgacacccgtttccttcaacttgaaactgctgttgagctcgagctttggcaggaggctttccgttccattgaggatgtccatggtttgattgcgggcaggaagggtactaagccttccatgatggccaactactatgagaagttgactcagattttcaaggccgagggcggtaagcagactgctgtcttccacgctgctgcttgggctagatacttccagcacgccgagagggccggcattgtcaatgacaaagcttctggctgtgtcttgctctctgcccttgccgtgcctcttggtgaagtcgaagtcaagcagaggcttgttgcccttctcaaccttcccaagacgcctactcgcgaggctcttgttcaagatgctgctgccaagcaccttaagcgcgtgcccgccgatatccgacaaatctacaagattcttgaagttgattttgagcccaccaccgcttccaaggttcttgctcctctcatcaccagcctctctcccgagtaccaaccttacctccccgctcttcgcgatgttgttctctctcgtttgctccaagctctcgcccaagtgtacgactctgtgaccctttcccacattcttgatctcgtcaagcccctcgataacaccccctgggccaccgacatgtcatcccttgaaaagttccttgtcacagcttgccgacgaggtgacattcgtgcttccgttgaccacgttgcgcagaccatcaccttcgtctctacccctcctgacgccaacggccttcagacccttgccgtctgcctctacaacactatccagtacctcaacccctctcgtcttgctccggtttctcgatccgacgctttcgccgctgctattgctcaggccgaggaagagcgcaaggctgctagtcacaagcggcagatcgtcattcgacgacgtgagcttttggaggaggcgaagcttcgtcgagagaaggaggcttctactgcccttgctgagcgtctcaagatcaaggccgaagaggatgctcgtcgagctaaggaggaggccaaacaggctgaaattgaccgagttcgcaagcagatccatgagaccaaacaggccgaggctaagcagctcgcagcttccctcgctgcccaaggtgccctcaaggtcgatatctccagcattgaagacctcgactcttccaagcttgttgccatgcaggtcgagcagcttgccaaagagaaaaaggagctttctgagaggttgcgtatcgtcggcaagagggttgaccacctcgagcgtgcgatgaggaaggaggagagaccgttgttggctcaggactacgaacgtcagaaagccgaggacagagcggctcacgatagggctaaccaaattgctcgagagcaggccattgagcagcagagggctgctagggagttgaagcagagattgggtagaatgttggaggactacgaggctgtcaaggaacgcattgagtctcagatgcaggaggaattgaaggcggctaaagaagaggctaggagaaagattgaggaagaaaaggctcagttgagggagaaggtcattaagaggaagagagaagagaaagaaaggaagctcaaggaggctagagaagctgaggagaggaagcgaaaggaggaagaggaggctgcccagaaggctgaagaagaagctcgcgctgctgctgctcttgaggctgaagctgctgccgctgaacaacgccgagccgagcgtgaagctcaacgtcaatcagacctcgaacgtatccgcgctcagcaagaacgagaagaagaagctcttcgtcgacgacaagccgaaaaggccgcggctactagcggtggcagcgcctacagaccgcctgcgcgtgctggtactactccccccacggcttctccagctccttcaagtggtggtccttcatggttagctcgacgaaaggccatggaggctcaaagcgccggtggtgcccctgtggccagttcacctaagccagtgccttcaaattctgccgcggcgtctgctcctgcatccaacggccccgagagcattgctggtgaagctgagaaacccgctttaactggaagtgtatggaggagaggtatgggagcgaggaggggtatgccgtccaccagaggtggggcttaggtaatctagaaggttgtgttttgtagaaatgcataattctttcaagtct

SEQ ID NO: 311 - DNA, 3396 bp, Aspergillus fumigatus
atgatacatgatgctctggacgaaaagctagcggaatatgcctttttccctctctcgcacatctttaacgagacccagagacttcccgcgcggacattggaactggctgttgattgtctacggattctgattgcgaaaggatggcgccggcacttgtctcctcagttgggcaaacagctcataatactgctgaccttgatcgtgggaggtgcgccgaatgaagtcagtggaggtcagtctctacattcgcagcccgtggagctcggtatcgcttgtttcaattgcttcgcggctatattcagtgttttggaagggccaaaagcaaagcaaacaatctttcatgagattggtacagccacaattgtcgaccaggctgtgtacattctcctcgaaggtgtttcggatggaccttcggacgaattctgtgtggctgctgcagaggcacttcgagctctgttcgatcgtatcactgatcgggtagttttggccagtatcatgccgcggacggtgtcgactctgacaaaggtcctgaagccgaccactcagatacgccgctctttcagggtaatctcgatatgtctacagattctcactaatttactccgaagcgttttgaacgaccaagccacgagttcggtcacggaagagtcgaatagaacccagcaagcggtcgacagggtagtcctggatgcatcttggttgaaagcaacgactacgcagattaggctggctctcgcgaacgttattcagataagacgtcatgaacggcaggaagtgcaggctgcgcttttggacctttgctcgatggtcatagaggactgttcggctaccctccacgattcgatacctctcatggtagaaacgattgtcatcctgtccatatcagaagaccatttacccaatcacgcctacattactctgaagcaccttgctaccacgtattctgttgtattggataccctcaaggactcgcttcacacctgggtcactgcctttccgaggactatgcaaggcaatgatgagacagccaagcagtggggaatcaagcagatatcagcggccttccaggtactttcccaggttcggtctggatctgatattcttacaagtgctctcgcatcaggcttgtgcgatagtgttgctgctgctgtcaaccaagactccaggaatccttcgccggtgactcaagacgtggttgagaacttaagtctggacgtactacatcgagacaatcggtcattgacgtttccctctatacttctgggtcaccgcagtcagcagcagactctcaaggatcttcaatcgatgatcgttcgtctcaatagctccgagtctggaagtgagattacaaggtccatcatcagtcaaatccaccgcgcctctggagacgcagtggtggctccgttctggttagccctgaactttttgagaactggttcgcagctcacgtgcattctcgacgatttcatatctttagatcatattgaaatatcggtccagagtctaagcagtaaggccatgatcgaggagctatattactactcgttgcctcttctagatcaacccctggcggagacctccagggattggcgaatttctgctctcgcactggaagcggttgctcttcaagcacagcaactcggcgaagcatttcgcccggagctgatggatgcgctatatcctgttctccagctgctcgcatcaggaaactctacccttcagaggcatgctatggtatgccttgacatcctcaccaattcttgcaagtacgaggataccagcaccatgatcattgaaaacgtcgattatctggtgaactcagtggccttgaaactgaataccttcgatgtctcaccttacccgccgcaagttctcttcatgatggtaaaattgtgtggtgctcgattgattccctatttagatgacttggttgactcaatgtttggcattctggatatgtaccatggataccccaaacttgtggaaacaatgttcaagaccctggctgccatcgtcgaggaaggcacgaaaaccccgtcactcctcgcaatcaccaatggcgacctcaagcccatcgatcatcggaagcggcaatacgagagactgctggtgcccactctggcagaggatttggctgcccgtagaacaaagcgagccaggtatatggatgaagacttggaggacgatgaagaaagagtgtcacatccgaaacagccctggaaagcagagcctgagaaggtcgagagcttggacgctgacaacctctctgacgtcttgaacgcggatgaatccgaggagccacttcctcctcctcgacagccggaggatgaggagaagccgctcagtaaatcacacacgattcttctacacattgtcaagtcaataccctcgcatctgacttctccttcgccctaccttcgtcgctccttattgtccatcctaattcaaggcttcccggccctggcgcaaaacgagaacagctttttgccagtcatcaatgatctatggcctgctgttgcttcaaagattagctttccgtcttccatgttcagtgagacatcgtcgaccgctctcgtggcaaaggacccgtccacgccgtctaccagagctgtcgatagcagcggcgcacgcagaatccatgagttcgacttcaaggaggagaccttcgtcagcactgccgcctgcgaagccatagaagtcatgtgcaagactgctggcgacttcatggcatcgcgcatcgaggccgaattcccccggtgggagcgcatctatcgccgcacatgggacaaagtgcgtcaagacgcagagagggcactcgagcgacgcgctcaccaccaatccagcaaaacactctcatccgagacacagacggcatcggaaacccaactccccctatctctatctcactctctatcggtagtcataccgggctccagctccagttccagttccaccatgggcgctcgcgccttcacaccacaccataccctttggcgcgccctgctctccttattcatgacccttctcacccacgtccgtctgccgttgtccacgggcgaccagatatgcgagttcctagccgattggataaccctctacgtcggcgcggactactactcccaattccatcttcaagccactgtttccgccactgatatacccgctgcccaacgtgccgagctggagcccgtcgagactgccattcaagccatggagacctggaatgcggatctgacttggttcatcttccagcagcgaaaggtacaggcaatcgcgacgtcgagtagaagcaaggcgagtactgtcgtgcctataatcagcgagatatcggagaatccattggagtcttggtcttcgttggccaaccgtttgaaatttgccccgccggtgttctaa

SEQ ID NO: 312 - DNA, 530 bp, Paracoccidioides brasiliensis
cggctgcttgaattcggcaccaggccaaatcgcccgctatctctactaccttggaagaatccgcgccatccaactgcagtacacagaggcccatgagcacctaatcggcgccacccgcaagtccccttcaacgcacaccgccggcggcttctaccaagcatccaccaagctcctcatcgtcgtcgagctgctaatgggtgatattcccgaccgctcaattttccgccaacctgccctcgagcgcgccattcatccttacttcatcctcgtgcaggcagtcagcatcggagacctggacggcttcgtcaacaccgtgcagaagcacaactccaccttccgacgagacggcacgttcacactcattctacgcctgcggcagaatgttatcaagacggggatcccgatgaagtcgctgtcctacacgccccttttcgctgcggcaaatcggacggcgtctcgggctggatagcacggagtcggcagaaattattggtggccaaggccattccggaatggggctgattgaagga

SEQ ID NO: 313 - DNA, 526 bp, Fusarium sporotrichioides
tacaatcgattctgcccagtttggaagcatttgcttccgagcgaccagatgaagcttttgagctcgcaaaattatccaagattttgctcttcaagctggatctttcggcgtctgcggatgacaagcaaggctcagccattggcaatctgatcagtgacaagcttttccagcttttccaaatctgcctgcaagccattggcaagtgggctggtacgccagagctaagatccatctactacagcatctgctaccgctacttgactggcatggctgaccaagggccactcacgtccaaccgacccaagaccatcaagaccatccaagtatatggtgagcggctgctcaatgttatctgcgatgatgcgtatggcggcgaggcgcagtgtcagacatcggcgctcatccttcttaacgccttgattagcatgggtcaccaggagagtgaggattatgtcgttgagactctgaatcgactcaactttatcggaattatggtcgattcgctgcgaaatattatgcaagagtg

SEQ ID NO: 314 - DNA, 1858 bp, Cryptococcus neoformans var.
atgatccacagccataataataatctcagtttctgttctcaactaatcacagttcgcaaaatggctgccttgacgagagctcttcccgcgcctctccatacctctactaccgaatacgaagaagcacccgctcccctccctaccactcctggtcctcagcttccaaagtatggtcaaagaaagggatggaagcctaagactgctgcagattttaatggtggtggagcttaccctgaatgccacgtcgctcaatacccgctggatatgggaaagaagaacaaagggcaaggatcaactttggctttgcaagtagaccaggatgggctggtgagatatgatgctatcgcgcaacatgggagagcccccgggtctcgggtacagtccagcttcaaggacttggtccctttggccaatcgtaccgatgtgactgaatccgagcgccaaatggaacgaccagacgatctttctgttgctgaaactgctgagcgaacgcgactcgctctcgaacgtattacccacggcaagatcaaggctgcgcagcccaaacatgttcccaagaccaacagcgacgccacctacattcgatacacccccgccaaccaaagtgccgatgaaggaaagcagagaatcatcaagatgacggaggttcaagaagaccccctcgagccaccaagattcaagcacaagaagattccccgtggtcccgccgagccacctccccctgttcttcaatctccacctcgtgctgctactgcccaagaccagaaggactggatgattcctccttgtatctccaattggaagaacaacaagggttacaccattcctctcgacaagcgtcttgcagccgatgggcgaggtttgcaagatgtgcatatcaatgacaattttgccaagttctcagaatcattgtatattgccgatagacatatcagagaagaagtcagggcgagggcgcagttacaacagttgcttgcgcagaaacaaaagaccagtaaggaggaagagttgcggttattggcccagcgagcgcgagaagatcgatcaggcttgtcatcctcagtttcaggatctgttgcggctgcgtctgcttccaggctacccgcagaaactggtatcaacctgggtggctacggcagtgagtccggatctgaagaggagagcgacgaggaagaagaggatgaggaagcgatcagggagcgaaatattgtcagagaagagaagaggagggaaagagagaaggagatgaggatgtctaatatgggttcagagatgagggccaagatgcttgccaaagaagcgaaccgagatatctcggaaaagattgctcttggccttgccaaaccttctgcttccaaggagaccttgctcgactcccgtctcttcaaccgagaagctctctctacaggctttgcctctgaagactcttacaacctctatgacaagcccctctttgccggatcctctgccgccgccgccatttaccgccctgcaggctcatcacgtaacgacgaatcatttggtggtggtacggaagaaggtatcaaagaggagatgtccaaagacaggttccaattgggtaatgcgactagagggttcgaaggtgctgaaggagtcgaagcgagggaaggacctgtccagttcgagaaggatactatcgtggcattggatggatccgccgatccgttcggtgtggagcagtttatggatgctgccagaagaggtggtaagaggactgccgaagacagggatgaagagagaaggaagagggcgagggatgaatagagttacgctatcaggttgttcgattaagtctattttcttcatctaactactgcatgtattttactttttgaga

SEQ ID NO: 315 - DNA, 501 bp, Fusarium oxysporum f. sp.
aattcggcacgagggaatacctcagcgcacctccccaccggctgatcgatctcggatcatcatcaataaatctcctctcttagtcaagtcatatacagaggaggttgcccagcatgcctcctccgccgcaccaaaagcctgagaatgttctcaagagggctcacgaactcatcggagtcggccaggctcccgccgccttgactctgcttcatgagcacatcaccaacaagcgctcccgaaatgtcccaattatgtcgctggagcctgtgatgctcctcctcgtcgagctttccgtcgaacagaagaagggcaagcttgccaaggacgccctttaccaatacaagaatatttcccagaacacaaatattgctaccatcgagctggtccttaagaagttcattgagctcgcggttgagaaggtcactgccgcccagcaaaaggcccgacgaagttcagggagagcattgacgctactgccggcacctccaacatcgacgatct

SEQ ID NO: 316 - DNA, 585 bp, Ustilago maydis
atggagtgctccttcggaattactggcaagggctataccatcatcgcgtcggactcgaatgcagcgcgttcaatcgtcaagatgaagacggacgtggacaagcaaaaggtgctcagcgaccatcttgtcatggcatactctggtgaaccaggtgatacgctccaattttccgagtggatcgaacgcaacagcagactgtacagcatcagaaaccatgtggagctcagaccaaagtcggcagccgcatggattcgcaagcagcttgcagagtcattgcgttcgagaaacccgtaccaggtgaattatctgcttggtggatttgacttgccaaactctgaacccgcactatactggatcgactacctcggcacgctcgccactgttccttttgccgcacatggctacggcgccttcttcgccatgtcgacactcgaccgctaccacaggccagacatgtcgctcgaggaaggtctcgacctgttgcgacgatgcatcaacgagctcaaacagcgcttcatcgtggatctcggcacttttaccgtacgtgtcgtcgatcgagaaggcgctcgtatcgtgcagctttga

SEQ ID NO: 317 - DNA, 754 bp, Phytophthora sojae
  misc_feature (721)..(721): n is a, c, g, or t
ccgtcttcatcaagtttcaattttaagactagcaatatgggtattgatcttgtcgctggtggcaaggtcgtcggcaagaagaaccgcacgaaccccaagtcggacaatgtgtacctgaacctgctcgttcgcctgtaccgtttcctggctcgtcgcacggacgccaagttcaacgacatcgtgctgcgtcgtctctaccagagcaacaccaaccaggctcctctgtccctgggcaaggtcgctcgcttcatgaagaagcacgagggcaagatcgccgtcgtggtgggcaccgtcacggacgacatccgtcttctgaacgtccccaagctctcggttgtggccctcaacttcaccgagacggcccgcgctcgcatcgtcaaggctggcggtgagtgcctgagcttcgaccagctggccctgcgtgcccccaagggctccaacacggtgctgctccgtggcgcccgcaaggcccgtggcgtgtacgcccacttcggccacaagtcgacgctcgagtcggtgcacacgcacgaccacgtcaagccgtacgtccgcagcaagggccgcaagttcgagcgcgcccgtggccgcaggaaatcgcgtggcttcaaggtgtaagcggcctagccacgaacactctgaaaccaggccttctctgtcttgtgccttccggacgtggatttcgcgggctgtcatcttcaagtggcgggtgtggcaggtgtancggcagtttggctaggagctgctgcgtgctggc

SEQ ID NO: 318 - DNA, 470 bp, Aspergillus niger
tgctacgaggcgccggttatgcattcgccgccgaggaagctcacggctgaggatcaggccgcgtggaggatcccgccgcctgtgtcgaattggaagaatcctaagggttacacggttccgttggataagcggttggcggctgatggacgcgggctgcaggatgtgtcgatcaacgataagttcgcgcagttcgcggaggcgctgtttacggcggatcggcacgccagagaggaggtcaggctgcgtgctcagatgcagcagaagctggcggagaaggagaacgcccacaaggaggagcatctgcgcgcgttggctcagaaggcccgcgaggagcgtgcagctgctggtagcagtcggcgcgattctcgtgccggatctcgctcgccgtcgcgtagcgtcacccgcagcccgtcgccctactcggctagtgaggatgaggatgctgcaccggagccggagcgccccgcgtc

SEQ ID NO: 319 - DNA, 2280 bp, Gibberella zeae PH-1
atgcccaagcctagaacaagacgtggcgtcggccgcgaggagaagaagcgaaagaggctcgaagaggctgaacagcagcaagaatcatacgagaacgactccaagcgccagcgcaccgtcgaagatgaaaacaacaatggctacgagtacccagatggccaagatgctcagcaaaatggcattggcgaaaccgagttctttggtatgctcgccgaagaggagcaagaatacttccgacgcgccgacgaactgctggagctgaaccaattcccctcggctgaagaccgcgacatctttctcgaaaacgtttacaaggaggcccagggcaaagagctcaagctcgccagcagtcaatcttgctcaagattgatggagcgaatcattcaactctccaataccgcacagaagaagcatctctttgaagcgttcggcggccactttctctccctcgttcagcaccggttcgctagccactgcgccgaggctctcttcttgaggtctgcgggtgtagtgtcgcaggaacttgctggattcgtctttgacaccaagggcaccgatacggatatgcaaaagcccgagacgtcaatggaggaccatttccttgcgacactagacgagctagagggagctctgtcctatcttgtcaccgaccgattcgcatctcacaccctgcgcgtgctcttgcttgtcctcgccggccgacctttagaagatgcctcagtgcgaagtctcgtcaagagcaagaagaaggagaagatttcagttgctggatctgctgccacagatgaggcaaaccagggcttgagagcagtgcctacctcgttcgccctggcagccaagaagattatccaggactcgaccgcaggaatggatgctactgctttgcgagtgctcgccagacaccccatcggaaaccctacgctccagcttcttctcgagctcgaccttaccctcaataagggtgagcaaaaagccgagtctgaacagccaaccctgctcttccagctcttgcccggtgctcccaagtcgctatacgacagttcatcagaagcctccgagtttgtcaacggcatgatctatgatttaatcggatcgcgactcatcgagaccctcatcacacatagccctggcaagatcttcaaggctctcaaccaaaacattttcctgcccagaatcgagggttatgtccgaaacgacatctcttcctatgccgccatccgtgtgctcaaccgcttgagtaaggacgatcttgtgcaggccgtggagaagattgcacccagcgtgcctcaactggttgtcaagtccaggctcaacgtcctcaagacacttttcgagagatgcaatgctcgtggagccaacgatgagatcaagaaactcaacaaggggctaaaggagggatgcggcacgactccagccgacctggtcatcttccttagtggtttgaaagatgaggaacagaagaagaaggatgtccagcagctgtctaagaacgagtacgctattcagtctcacggagcccaactcctcaccacactcctaaagatccccggtcctactaagggtgttcaagaatctcttcttgcccttgagccggctactatcgtccgcctcgccaccacctccatgcctaccgttaccgtcctcacaaccgccctgtccatttcatctgccaaccctgctttccacaagtccatcgctagcgccatcttgcctcacacacacgagcttgcagtttcgcaatttggccacaacctaatcaacgccatcgtcgaggtccccagcaagggcagagagcgaagtattccgttccacatgaaggaagcctttatggcacgactcggcgagcacgaagcagaactccgagacagctggatgggcagaagtgtttggcgcaactggaagggtgatatgtggaagacacgccgcggagattggaagatctggatgaaagaggttgatgttgacattccctcaaccctgcctcagcgtggacccaagactgcagagaaggagaagccaagatctaaacctactgaggagatcatggaggagcctatcgtagaggagcctgttgtcgaagagcctgttgctgaggataagatggacgtggatgagccggttgagcaggctgataacgacgacgatgccaagaaggagaagaagaagagcaagagggacaaaaaggagaaaaaggagaaaaaggagaagaaagacaagaaggaaaagaagaagaagagtaaatctgacgatgccaaggcagacgatgagatggaggagtaa

SEQ ID NO: 320 - DNA, 3234 bp, Aspergillus nidulans FGSC A4
atggactacttcggcgaggatgaccccaatcatagccctcatctcggggagattgcctatcctgacattgatgaaactgtccaatacccatggcaagggagtgggcaatccttctcgcacgaggcttcagccatagacccgcgtctgtacaaagacttattctcagggggcgagtctcaggagcctacacagtccgcagctgatgaggagcaatttgcacctgaagaggaacagtctctagagctggataactctgacgaatcatccagttttgtagcatcgtctgaagaggaaacatcggaggatctttcggatgatgatgccccaggctcagaccaggaagatggactccgtcgacgccgtcgacgcagaggtcgcttctccggtcgatttggcgcccgcgggggtaaaggaatcaagagaggtccccgcaaaccggtagagcccagtccggagttcaagcttttgcactcggaggcaacatctgctttcatcgatggggactatgaccgcgcaatcgaccttgttaggcgtgccattcaggtcaaccctgagatgtttgcagctcactccttgctctcagagattttcctagcccaaggcgagaaagaaaaggccgtgacagcactgttcagcggcgctcacactcggccaagagatacaacagtgtggttgaaggtggctaggatgataacggaacaggcaggcgacgatagacaggctgtactgaacgacgtcctctactgctatagtcgcgtgcttgaaattgatccccaaaaccacaacacccgcttccagagggctgccctctatcggggcttgggtcacaatggacgagcagtaaccgagtatgagagaatccttagggatcttcctcacaacgttcgagcgctccggctccttacagataccctttccgagcaaaatcaatatcaaaaagcgcttgactattggtcagagagcatacagcactatatggcacaggagcctgaggagaccccagagttcacgtggtctgacgctaatatttacatcgagctgtatacgtacttgggacggcatgctgaagggctcaaagctgcgaaagcggtgtcgcgatggttattggggcgcaaagacgacactatgtgggatgactttgacgaggatgatcgtgaatgggaccacgccgacttccctcgaaggattaaagcagatggttatattccgaaacagtggccgccggactcgtatggcccaggtttaccccttgaatttcgcataaaactcggtctcttccgtttgaagctaccggagcggcacatcaatgaagctcttcatcacttcagatggcttaaaccagaggatacctcagacgggtctctagtttacgattacggtgacctctttcgagaagccgccgacgcgctcaaagacgccgagatgttcgaggacgcccttcgattctataggcccattcagaaaaccgagtacgcggatgtcagcttcttcatggccatgggagattgcttcaagtccctgggcgaactggaagacgcagaaaattgttatttgactgttgcagaacatgacacaagcaatattgaatctcgagtgcaacttgccaagttatacgaaagcataggaatgaccgagcaggcgctcagatatgtcaacgatgccgttctactaggacggcaggagcatagaagtaatcgccgacggaaggatacccggctcgaagagctcgcaagggagttcaagtcggtgaatgtggccgcagggcctaaagaccagtccgttgaatcctcatcagcccttggtaacaagggtgaggcagaaaggaccgaaaatatacagttccttttcaagaagctgacgcaattggaaccgaaactccaagctggagactctgaggccacggaggactggctagacattgctgacgctcttctgcgtgaatttcgttccaacagaatcttttacccgcttcaacgcaatgtggtattccttggatatagtagcaaggcgggcaaggatgcgcttatggatgaattacaagaaatggcgaatcggcttcaggagtcactaggtgcgtctacaatccctacagactaccatggcatcagtttcgacgaatggcttgacctattcctgcagtacgccctaacggtggcaggtcaaggtgaattcagcgaagcgtatgatactctaggagccgctgcggacgcgagtgtctggtaccactctagagacagctcaagattgattcatgtgtgctggttcacttgtgcactccgactccaagacgaagaaactctcgccaacgaagctcgctggtttattaaagagtaccaatttgtgacagacacataccgcctgtttgccatgcttagctgtctcagcggcgaccctcaccgatcgcttttccactcatcccccttgatgaagttcatgctccgccagattaaagccatagactttaccctccccgaccacatcgccggcgcccgtcacaccaaagccatccgagaatcaatctacaaggaacgagcagcactatcaacaaaagacgagaagggagagcctatcccagcagaggaaatggacgtagccctacttgtcctctacggccacatcctctactcaggaaacagcttctacccagccctcaactacttcttccgcgcgtacgcactggacgacaagaatccggccgtccttctttcaataggcctctgctacatccaccactccatgaaacgccagtccgagaacaggcacttccaaatcatgcaaggactctccttcatgaacgagtacaaacgcctccgcgaacgcaagggaacaccccttgtcgagaggcaagagatggaattcaacttcgcccgtgtttggcataccctcggactcgcgcatctcgcagtggaaggataccagcgcgtcctcgacctcggcaaagaaatacaagcacaattccaaacaaaacagttgcttactcctgctcacgcagccaatggagcgcaagcagacgataacgatgcagacatctcaatgcccgacgtcgactccaatgtcaatatagacgtcaatgttgatcgggccacccacagcgtagaggtgaaaccgcaatcgccacagcctgtcatagaaaacttctcccgcgaagcagcagttgccctgcaacaactgtacgctctcaatggcgacttccagtccgcacaggcggtcacggcggcttggcttgtgatctga

SEQ ID NO: 321 - DNA, 763 bp, Phytophthora infestans
  misc_feature (615)..(615): n is a, c, g, or t
ccggtccggaattcccgggtcgacccacgcgtccgttccttacgatctctttctccggcgatatctagatccttaaggttgtaaatgatgaagatcgattttagtggacttgaaccaagtgccccacttcgaggggaatcttctgagctgtttgatggaatttcaaattctccatcattccatcttcctaatactgctaattttgatggttttcaaaaagaagcaatccaaatggtgaagcccgcaaagggaaccacaacccttgctttcatttttaaaggaggtgtcatggttgctgctgattctcgggctagcatgggaggatatatatcatctcaatctgtgaagaaaatcattgaaattaatccctatatgcttggcacaatggctggtggggctgctgactgccaattctggcatagaaacctgggaatcaagtgccgtcttcatgaactggcaaacaaaaggagaatttcagttactggagcttcaaagctgttggcaaacattttatattcgtaccgtggaatgggtttgtctgttggaactatgattgctggttgggatgagaagggtccaggactatactatgtggatagtgagggaggacggctnaaaggaaacagattctctgttggatctggttctccttatgcttatggggctttggataatgggtacccgatatgatctatctgtggaagaaccagtcctgttgcttagactagcaatttattcctgctacattccggtgtggtgcttg

SEQ ID NO: 322 - DNA, 644 bp, Aspergillus flavus
taggcagtgtcagccgcagtccgtctccgtactctgatcggtctcgcactcctagtgatgacgaacaagctgcccgggagcgcgagcgcatgcgtcgcgaacgccgccaggaaaacgagagacagctccgtcagtcgagaatgggtacagagagacgtattcaggccatggcccgtgaacagaatcgtgatatctcggagaaggtcgctctgggattggccaaaccgactcagtcttccgagactatgtgggattctcgtctgtttaaccagacgagtggaatggactccggattcaacgaggataacccttatgacaagccgttgtttgctgcgcaggacgccatcaacagcatctaccgtccccgggcccaagtcgatgccgacgacgacgagggtggtgccgagggagaaatgagcaggattcagaagtcgaaccgatttgaagttctgggtaaggccaaggaaggcttccgtggagccgctgatgccgaggctcgtgatggtcctgttcaattcgagaaagacaccactgatcccttcggcatcgacagtatgattgccgacgtcaccggcggagctggacagaagcgctacggcattcaggaagtcgatcgtgaagaccgtggctccaagcgcgccaga

SEQ ID NO: 323 - DNA, 633 bp, Phaeosphaeria nodorum
ccgaaccgacctgccctggtatcctcacattcgactcggacgtcttctcatccgccaaggccatgcaccctggctctggcgccggctctgccgagactgagacccgctctgtccagcgcctgcaaagcacacctgctgagattgttcggactcagctcacccgcctagcaaaatctctctttgtcacatgccaatacgttgatccatcattcaacgccgaccgacacagggcgaaggacgctgctcttgcgcgtgccaaggagggtgctgagaaggagcaccaggatatccttactcgtcgtgatatcatctctcagaagaaggaggctgccttgaaggcccaacaagccaaggagaatgaagagcagacgaggaaaatgatccgccagcaacagcagaaggaggaggagtcgcgtcgtctggcagaagagcagaagcagcgtgctgaagcgcgcatcaagcaggagcagcagcgaatccagcgagaggagatggcgaagcagattgaggagctcaagaagactaccaaggttgatatcgaccttccagaggaccttgcagaaatcgactccacccgcatccgtatcctcaagctccaagctctcgagaaggaaaaggaacaacttggcgagc

SEQ ID NO: 324 - DNA, 257 bp, Fusarium sporotrichioides
ctggtggtgctgcagactgccagtactggctcgcctggctcggcatgcagtgccgcctccacgagctccgacacaaacgccgcatcagcgttgccgccgccagcaagatcctcgccaacctcgtctacagctacaagggcatgggcctcagcatgggcaccatgtgcgccggtgttaccaaggaggagggtcccgccctttactacgtcgacagcgatggcactcgcctggcgggtaacctcttctgtgttggatca

SEQ ID NO: 325 - DNA, 325 bp, Conidiobolus coronatus
  misc_feature (54)..(57): n is a, c, g, or t
  misc_feature (74)..(76): n is a, c, g, or t
  misc_feature (90)..(94): n is a, c, g, or t
  misc_feature (184)..(184): n is a, c, g, or t
  misc_feature (201)..(203): n is a, c, g, or t
  misc_feature (321)..(323): n is a, c, g, or t
  misc_feature (325)..(325): n is a, c, g, or t
gcacgagggtgccggtatgggtactcttttaatctctcgtattcgtgaagaatnnnntgatcgtatgatgtgtnnnttctccgttcttcnnnnncctaaggtttctgataccgttgttgaaccctataatgctactttatccgtacatcaattagttgaaaactcagatgaaactttctgtatngataacgaagctctttnnnatatttgcttccgtaccttaaagctctctactcctacctacggtgatctcaatcatttactcactttagttatgtctggtgttactacctgtctccgtttccctggtcaacttaatgnnnan

SEQ ID NO: 326 - DNA, 687 bp, Phytophthora infestans
ccggtcggaattcccgggtcgacccacgcgtccgcaatatgggtattgatcttgtcgctggtggcaaggtcgtcggcgagaagaaccgcacgaaccccaagtcggacaatgtgtacctgaaacttctggtgcgcctgtaccgcttcctggctcgtcgtacggacgccaagttcaacgacattgtgctccgtcgtctctaccagagcaacaccaaccaggctccgtcgtgtccctgggcaaggttgctcgcttcatgaagaagcacgagggcaagatcgccgtcgttgtggccaccgtcacggacgacatccgtcttctgaccgtccccaagctgacgattgtggccctgaactttactgagaccgcgcgtgctcgtatcgttaaggctggcggtgagtgcctcagcttcgaccaactggccctgcgtgcccccaagggcaccaacacggtgctgctccgtggtgcccgcaaggcccgtggcgtgtacgcccacttcggccacaagtcgacgctcgagtcggtgcacacgcacgaccacgtcaagccgtacgtgcgcagcaagggccgcaagttcgagcgcgcccgtggccgcaggaaatcgcgtggcttcaaggtgtaagcggcctagccacaagcacactgaaaccaggctttctctgtcttgtaccttcggacgttggttgtatt

SEQ ID NO: 327 - DNA, 460 bp, Conidiobolus coronatus
ccgcttagaagaagtttaccaagttgtttgccatcaaactttccaattttgtcttaaatatcaaagaaaggttgaattccgtcgcctttgtgaattacttcgttctcatttacacaacttctctaaatatgctcaccaagctcactcagttaacttgaacgaccctgaatctcttcaacgtcaattaactactcgttttgaacaacttaatatctccaccgagttagaattatggcaagaggctttccactctattgaagatattcacagcttattaactcataccaagaaggtccctaaggctcaaatcatggctgattattatagcaaattagttactattttaaaggtttctgaaaaccatctcttccatgctgctgctttaaaccgctacttcactgttatgaaccaacaagcctccactgcttctgctgaaaagaagcaagctattgctgaaaaa

SEQ ID NO: 328 - DNA, 2100 bp, Aspergillus fumigatus
atgccacgcgaaaagcagaaaagaggtcgccgcgcggaggacaaggccaaaaaggacgcggccaaacgaaagcgcgatgaaggccctgaggaatccgcggtcaagagattgaagccctccgccgagacaaatacctcgaacaatgagatcatttcaggagcggattacatccccctggggcaagacgatggcggaaatgatgttccaatgaacgatgcgcccgcgaatgatatgcctttctacggtctccttgacagcgaagagcaggaatacttttcgaaagccaacgaggtattggagctgaaccagttccacgatgcggaagagagaaggcttttcgtcgacagtgtctacagggaagcggacggaaaagaattgaaggttgcttgcagccagtcttgctcgcggcttatggagaaattgatttcgttgtccgacatgcgccaaattcggagactcttcagcaagttcattggccatttcttgcatctggtgcagcatcggtttgcgagtcattgctgcgagacgctgttcatcaacgcggcgcctggagtaacagagaagatctccaagtcaaaaggccgtaaggcggaagtggacgaggaggacgagcctgaaccggaattgtcgctggcggaaatgttcatgaaggtcgttgaggaattggaggggaactggggatatttgctgacggaacggtttgcgtcacatacgatccgagtcttgttattcgttctcgctggggagcccgtcgacctgtcatccaccgattcggttgtcgccagccggaagaaggaaaggttgggaatcgtgaacacggaggcacctgaggaaaaggccgctgcggagaagcgtaaagtaccagaagttttcgaggctacgctgaaaaaggttatgaatgacatggtttccgggctggataacacctacttgagagcgctggcaacccatcctgtagggaatcccgtcttacaggtgctggtgttccttgagctgtcgcactttggcaaggcgagcgctaaggatcctaattcaatcatcaggaggctcattccggatgatgatttcggggagaatgctgagagctcgacattcgttagaggtttactctatgatcccgttggctctcgtttgctcgagactatcatcaagtccatgccgggaaagctctttaagagtctgtacaagaacattattcgtgaccgcattggctctcttgcacgcaatacaacggctggatatgtggttctcaggacgctggagagattaggaaaggatgatctacaagatgctatggaatcaattattcctgaaatcccgggtctcattgagagatctcgtttgattgtccctaaagtgttgatcgagcgatgcctcgttcgcggggttgacaccaaaccactttcagatgccttggaatctgcatacgacaaagacccggcacaaagattggaacaaatgcttaagcttgagcccgcggcaagtgaggacgactcagaggagaagcgaaagcagacgggcaacaatcagacagcagccgcagagaaattacatggctcgcttcttgctcaaacgatgcttacagcttccggacctgtgagcgggctcatttattccagcctgctagcgcagtctccagattcacttctcagattagccaaagatccaacagcctcccgtgttcttcagcaagccctaactgctccaacttcgacatctcagttccggcgacagtttactacgcgcttctcgggccacctggtagaactcgcgcttgatagcagtggatcccacgttgtggacgcgctatggccggcaacgaaagacctgttcttcgtgaaagaaagaatggcacaggaattgctcaacgaagaactgagtctccgggactctttcgttggcagagcagtatggaggaattggtccatggacctctacaagagacggcgaggggagtgggcttcaaaggcgaaaggcctggacagtattgaaaacggccaacgcgagcggcctaagtctcgcattgacttagcccgggctaaatttgcagcaaaggcggcggaagagagttctaaggcgccggtagctgcaaagacttga

SEQ ID NO: 329 - DNA, 388 bp, Blumeria graminis f. sp.
  misc_feature (177)..(177): n is a, c, g, or t
  misc_feature (286)..(286): n is a, c, g, or t
  misc_feature (289)..(289): n is a, c, g, or t
  misc_feature (292)..(292): n is a, c, g, or t
  misc_feature (353)..(353): n is a, c, g, or t
gttcaaactgccctatgttctatcccgcctcgtggcctaaaaatgtcttcgacattcgtcggaaactcgacttccatccaagagctcttcaaacgtgtcggagatcaattcacggccatgttccggagaaaggcatttctgcattggtacactggcgaaggaatggacgaaatggantttactgaggccgagtctaatatgaacgatcttgtctcagagtatcaacaataccaagaagcttcaatctcggagggtgaggaagagtatccagaggaagtaagcaacnaanaanaatagatcaaaattgtccttttaacacattgttctgtactgtatctgaagtagcggatacnatgaactgtaccccattaatcgtaccgttccaaaa

SEQ ID NO: 330 - DNA, 562 bp, Phytophthora sojae
cgcaaggcgctcgcgccgtacctgcagctcaccaacgctgttcgcgtgggtaacctggaggacttcaacgtggttttggcgcagcacggaccagtcttcaaggcggacaacacgtacacgctgatccttcgcctgcgtcacaacgtcatcaagacgggtctgcgcaagatcagcacctcgtactcgcgcatcctgttcacggacatttgcgagaagctggcgctggagaacgcccagaacgccgagttcgtgtgcgccaaggcgatccgcgacggtgtgatcgacgcagtgatcgaccacgagaacggctggctgcagctcaaggagacggtgaacgtgtacacgacgaacgacccgcagaccgccttccagaggcgcattaccttttgcctggacgtgcacaacgaagctgtcaaggccatgcgctacccgccggatgcatacaagaaggacctggagagcgcggaggagcgtctcgagcgcgagaagcagggaggaggagctcgccaaggaaatcgaagacgagatggacgaggagggtctgtaaccagacggcatcctg

SEQ ID NO: 331 - DNA, 727 bp, Paracoccidioides brasiliensis
tttcggcacgaggatacattcaaaacatgtgtgcagcaagacatcgacgaggttgcccagctcgttcatggcttagaggctgccagcggcagcagcaggagaagaggtggaggaagtggtccaggaagacggacgttttcctgcaagaagtctacctttctcgttcaaggatcagataacatcagcgtggactcttggaggttccaggattgggattacaagcgggatgatttgcccacctatgcacgcggcctatttaccaccaggaataagaacaacaattatgaaatcgccattcgagggtacgataagttttttaatgttgacgaggttgactcgacacggtggaggaatattgaaacaaatacaatagggccatatgagctgagtgtcaaggaaaatcgctgtattatttttatttctggattggaggatggcaccttgctagtatgcagcaagcactcgactggcgctagaactgatgttactgtcagccacgctgttgccggtgaaaactgggtgaggcaccacgtagcctctgtggcagacagtgggagatttaccaggcccgagaagcagaatttaacagctgtggaaacttgtgatgcctttgagacatgtctgggtcgatgacggcgcgggcttattcctggccaataatgtcccattgtaccactgcccgtgtccatttcgcatgggttcaagccgctttaggtctttgttactc

SEQ ID NO: 332 - DNA, 725 bp, Cryptococcus neoformans var.
atggagtgctcattcggtattactggcaaagactatgtcatcctcgcctcagacatgggcgcgggacgatccatcgtccgtatgaagtctgacgagaacaagctcaagaccttgggcccccacctcgccatggcttttagcggtgaacccggagatacaaacaattttgccgagtatatcgagaggaatatgcgactgtacaacatccgaaaccatttcccgcttcttccaccagcagcctccgcttgggtccgacgtactcttgcagaagctattcgatcccgacacccctatgctgttaacctccttcttggtgggttcgataccaccacctcaaaaccccacttgtactggatcgattatctcggtaccaaggcgattgtcccttatgctgcgcatggtatgggtgtgtatgttagtttgagtacgatggataagtggtggtacgaggatatggacaagaaggagggtgtcgacttgttgagaaagtgtattgacgagacggagaagcgtctcacaatcaagttcgactttaactgcatcctcattgacaagaacggtatccacaaggttgacctttcccaagcagaccccatcgccaacatccaggaacacccacaagaaaccgaggttgaagcgcctcatccccccatagaagttggtatatccgcctaaggtgttgtgtatggagcaatgcaagtagttgatgtattttataagaaaca

SEQ ID NO: 333 - DNA, 465 bp, Candida albicans
atgtcttttattttaggtcgtactgatgctccattcaacaaagtcatcttgaaatctttgttcttgtctaaaatcaacagaccaccagtttccgtttctagaatttctagagctttgaaacaaaaaggtgctgctgaaaagaccattgtcgttgttggtaccgttaccgatgacaacagattattggaattcccaaaggccactattgctgctttgagattcactgccggtgctaaagacagaatcttgaagaatggtggtgaagccattactttggatcaattagctctaagagctccaaaaggtcaaaacactttgattgtcagaggtccaagaaactccagagaagccgttagacactttggtttcggtccacacaaaggtaaagctccaagaatcttatccaaaggtagaaaattcgaaagagctagaggtagaagaagatctagaggtttcaaagtttaa

SEQ ID NO: 334 - DNA, 1917 bp, Ustilago maydis
atgctccttgatccttacatcaagtccagcgacgggcacactcgcttcaagatgtcagctacactacagagcttcttgccagcgccaaaatatagcgcgctcccacactctcgtgacgatgacgagaatgatgagtacgataacaccgaggctgggccctccacttcatcctcatccagcgctctcgtctcgacatcttcccctagcatccctccttacggccagcgagcagcatggagaccgcgcacacaggccgattatgccaatggtggtgcctatccggaatgccatgttgcccagtatccactcgacatgggtcgaaatcgttccgcggccacctccaacaaacttgccatgcgcatcgatggcgaagggaataaacgttacgatgctattgtaaaacaaagcttgcgtcccggacaaacggttcaaacggagttcaaggatctcgtaccgctgtctcagcgaacggatatcaaagagaaggatcgtaactctggttttgaacgaccgtcgcacgaggaggtgatgagcaataccgaacgaacgcgtcttgcgctagaagccatcacaaaaggtaagaacaagccggtcgtgcccaaagctggaaacctaccgggccagcagcaagcggcgcaattcatccgttatacgccggcacagcagggtgcaggcaacggcacacaacgcatcatcaagatgaccgaagcacagcgtgatccgttggaaccacctcgccatcgattcaaaaagacggctgctggaccaccttcccccccaccacctgtgttacgctctcctccgcgcaaagtgaccgcgcaggagcagaaggattggatgatcccgcctgccgtctcgaactggaaaaataacaagggctacaccatacctctcgacaagcgactcgctgcggacgctagtggcattcaggacgtggtgatcaacgacaactttgcgcaatttgccgaagcgctccatttggccgataggcatgcgagagaggaggtgcgacagcgtagtattatgcagcagaaactggcggccaaggagaaggcggccaaggaggagcatttgcggaacctggctcagcgcgcgagggaggagagagccggagtgtcttctgctacgccatccgtgttgggacgtgacgatgatgtggcttcacgattggctgattcggacgcacgtcccactcgagcgacaccaagagcagaaggaggcatgtcggcaatgcttgcaggctacagatccgattccgattccgacgaatctgcagcatccgatgaagaagacgatgaaggagcaagagaacgcgatcgtattcgtgaagaacgtcgtcgcgaacgacaacgcgaactacgcatgtccaacatgggcatcgaacagcgaaccaagcaactgcttcgagagcagaaccgtgacatctctgaaaaagtggctttgggtctggccaagcccacggcgtcgaaagagtcgatgacggatagtcgacttttcaaccagggcgaatcactcgctgctgggtacggagatgaagactcgtacaacctgtacgacaaaccgctgttctccggtagcagcgctgctgcggcaatctacaggagaccggcagcaagaggtggggccaacgacatttacagtggagccgacgatacagcgttggaagaagagctcggcaagaacgatcgtttcggtctgggtcagagcaagttcagaggcgttcaaggtgatgcggatcgcgattcaggcagtggcagcgcaccagtcagaagcggccctgttcagtttgaaaaggacaccagcgatccttttgccatcaaccagtttctggaagacgcaaagagaggcatcaagcgcacttcggatcaagacgccgacgatgcgagaaagaagctcagagacgagcatgattcgtag

SEQ ID NO: 335 - DNA, 741 bp, Aspergillus niger
gagaagctcaagctccttacgaagaagattcaaggctctttgaatcgtctggaaaccgggggcaatgtggtgaagcatgcgatcgggcccatctacagcaatacccaatcgctacagatcaccaacagcaacatagataaagtcaatgaagccattgagcgcctccgccagcctctggatgccaagggcaaggaagaaggaattatacgatcaagcccccagaccgtcggtttgtcgcaatacctctctgctgtgaagcgcgtggaaaaggccttggtcgacctcaactcaaccaatctgcgatcgaaccagaaagctatttccgaatttacttctttgctggtgcttggaaactcccagctccaggacatgctccgcggcactttgagcggttacgttaatccgatcgaaccattacactacctaacaaaagaactctcattcccctctctacctgatgagaccatcgcggagttgggtccagtatgttcggctatcggctctgcagcgagctatggaccgcagcggggtgatggcggaaaccccgccctcaaaatctacgccgatattcgtggaccatatatcacatcgagcttgcagaacctggccatagcatctctcaatactgtcaaacgacgggctgccgacggcccctacaagcaaggcaccaacggtattgggatctattccaacgctttagaaagctttatctatgcagaacatgatatcctcgtacgcgtc

SEQ ID NO: 336 - DNA, 2130 bp, Ustilago maydis
atggcgcccgcactcaacctcccagcaccagcgcacggctctgacaacacacttgcctcttcgtcaaccccatcaagctccaagtttgcctcgacgagcggcataatttttccgccgcccgagctacgcagaaccattgacaaggcagcagagcttattgcaaaaaaagatccgtcgttcgagaacaacatcaaggcggcagaacagaacaatcccaagtttgcctttctcaagttagacgatgcctaccacgcctattacgcttcgcgtcgcgatgccgttcgacgtggcgagacacttgcgccagttatacccgagtcttcgaccaatgctgtagctcaagatggctcaaacacgccagcgacagccgacgctgcagccggtgcttccacgcagcctccaccagagccacaaccattcgaattctccgccgaccttcccaacatcaccgctgtcgacctcgacattctcaaactcacagcgctcttcacggcacgaaagggccgctcttttgcgtcctctctgctctctcgcgagtccaagtcgtaccagttcgaattcttgcgtccatcacactcgctgtttacctatttcaatcacctcgtcgagcaataccaaaaggtcatctcgccttccccctcacttcttgaaaatgccaagcttggagcatatggcacaactgataccgccctcatagcacaacaaaaggcaaagcctgcgctcggagcaggcaagggtggtgcaagaccgtatctattggaacaggccaaagcaagggcagagtgggaacggcatgtacaagacaagcgcaagaagcaggacgaagaccaggagaggcaacgtcaatcattcaacgagatcgattggcaagactttgtcgtcgtcggtactgtagagctcaccgaggccgaccagcacgttgacctgccaccaccccgctcgttgcgcgagatggaatccatgacgctggctcagaagaagatggcaagcatgattatggagtcccaagctgctgcagacgacgtcgaagatgtagaagagcttgcaatgcccacaagacctcctgcgtcgacgccgcttgtcgaagaggtccagcaaccagccgctagaggtggtaccatcaaggtgcgcaaagactacgttccacgcggtcttgcgtctcgcaccaagcctactgcacctgatgctgcaatgacaaagtgtcccgtttgcggagatcaggttgccatcgacgaaatggctgaacacgtccgtttcgaactgctcaacccagcctaccgcgaacagcgtcagcaactggaagccaagaaagctcaacaggctgcgcttcaagctggcgcagaccctacctactacctcaagcaacttgccacgagtcgtgatgacgaggatgaacagacaagattgaagagagaagccgaggagaggagacttgccaaggaaaaggaaaaaatcatctgggacgggcacgccaaatcggggcaagccgccagagatctgatcgccaagaatgttggtctggagcaagaaatgacgaggctgtccggcaagcctgtagtcaagctgccggagtttggcccgcaattccctggcatggaccgagccgtgtcggaagaggctccggccgatcaagctgatgacaagcccctccagctgcccaagggtagtctgttgcccgccaaacctgttacgacttcagcaacgtctccaccaccacaaccacaagcctcttcatcgagtctcaagcgttctgcttccgtcgagctctcccctccaccaccgccgcctgcacccctcccttcaacgctagccacactcgccaagaaaaccgatggatcactgcaccccgaaaagatgtggatcgaagcacatgctcgtccgactgtcacgcttaccctctctcttccaggtcaagacgatgcagacagaagggaagagccttacgaggcagcgatcaagtctaccgtagctacgttgagggactacgttcatcaagatctgctaaacagtacaattgcagccagcaagatcaagatcaaggtcaatggcaggcccgcgacgctcaagcaaagcttggcctactggaacctgactgacggcgatcgcgttacgatcgatattgcacagtag

SEQ ID NO: 337 - DNA, 655 bp, Alternaria brassicicola
  misc_feature (570)..(570): n is a, c, g, or t
  misc_feature (619)..(619): n is a, c, g, or t
tagcgtggtcgcggccgaggtaccggtttttggttaggagaaccgggagcaagttcgatgcagtgatccttaagaggcttttcatgagtaaagtcacaaggctcctctttctctctccaagctcgttgagttcatgaagggaaaggatggtaagattgctgtgttggttgggactattactgatgatttgagagtgcacgagatccctgcaatgaaggttactgccttgaggtttacggagagggctagggctaggattgagaaagctggtggagagtgcttgacctttgaccagcttgctctcgttgctcctttgggacagaacacggttctacttagaggaccaaagaactcacgtgaagcagtgaagcactttggtctagctcctggtgtgccacacagtcactccaagccctatgttaggtctaagggaaggaagtttgagaaggctagaggaaagcgaaagagtcgtggtttcaaggtctaagaaatactctgttgtttcgttatggttggtttcataatcgaaattttcatagagaactctcgttcctcttcatttcttgccanacaatggttttaaagcttttttgtccgtttattatggttcctaactcgnaccattttaaaatgtttctttgcctttaaagcaaat

SEQ ID NO: 338 - DNA, 569 bp, Fusarium oxysporum f. sp.
atgcgtgagattgtaagtacctctctttttaagttcgtgttgtgctgttgcacgcgttgagtttatcatgcccctgattctaccccgctgggcggtggcagctcaacgacaatgcacgatagctaccagctttaccataccttctgtcaagacaagaagctaatcagatctcttctctacaataggttcacctccagacyggtcagtgcgtaagtgctcatcgcttcctcaacgtcgcatgcgggggatgctcacaatgtttatcagggtaaccaaatcggtgctgctttctggcaaaccatctctggcgagcacggcctcgacagcaatggtgtctacaacggtacctccgagctccagctcgagcgcatgagtgtctacttcaacgaggtatgcattaacagtcaatgtcaagaattcccaagctcacacaactaggcctctggcaacaagtacgttccccgagccgtcctcgtcgatcttgagcctggtaccatggacgccgtccgtgctggtcccttcggtcagctcttccgtcccgacaacttcgttttcggtcagtccggtgc

SEQ ID NO: 339 - DNA, 3576 bp, Aspergillus nidulans FGSC A4
atggatagctcccgccagaaagctttcaaaaagctccgagaaccatgtgtggagctaagctctgttggattgaagttccgtggacatcaagctagccctggcgatgttctgaaagcactccgttccgtgtaccatgtcttaaatgagctcgccgaagagcatgtcttggatgagaagcttgcggaatatgcattcttccccttggcgcacattttcaatgaatccaaaaggtcaaccgtcaatgtcttggagctggccattaactgcttacggctacttgtcgcggaaggatggaaagcacggctatcccctcaaatggggaagcagctaatcatcctcttgactcttgttgtgggaggagctccggatagcgcaaagaatgaccggattatacagacatcctctgttgaactggagatagcagggttcaactgtctgtttgcgattttcgatgtactctccggacccacggcggaagagacaatctaccatgaaattgggaccgccacggttgtcgatcagaccgtatatctcttgctcgaggcaattgttggtaaccgatctgatgagctttgtatctctgccgccaaagctcttgaggcactttaccgacgtgtcagcaaccgcgtcgtactcgcgagtatcatgccccggaccgtgtcagcattgacaaaggtgttgaagcctacgacacagaccaagcgatcatataagctacttgcgatttgcctacgtgtgctctctggaatattgaaagcagttctcaatgaccgggtcaattcgcaattgccggaaaagtctgctcagccgcagggtgctgacgagacactagtgcttgacgagtcctggttgaaagcaacgactactcaaatcaagctcgccttaacccaagttattcaactgaggcggcatgatcgggaggaggtccaagccgaacttttgagcctgtgcatcatgatcatagaggactgcctcactacattacaagaatcgatacctgtgcttgtcgagaccatcgttgtactatcggacctagatgagcaacagatgccaaacaatgcatactcatccctaaaacatctagctaccacttatccaacggtgctagattcgctgaagaactctctgcatacctggcttactgcattcccgaggacgatgcaaagtaatgacgaaacggctaagcaatgggctataaagcagataacaactgcttttcagatactgtctgagcttcagtcagaatctgaccttcttacctgcgatctaacagccggattatgcgacagtgttgctgtaatcgctgaccgcgcgaccagtgcacttcagccattgaactcggatctggcaagcaatcaaacatttgagattctaggcgccggaaaagaaagtgttaccttctcacccgtgctgttggaccacaaaagtcagcggcagactctcaaggaccttcgggggatgatttcccggcttaacttttctaattctgctaatagtattacgcggctaatcattaagcgtattcaccaggagcagggaaactcaataatcgcaccactatggctggccacgacgttcctgaaggataccacgcagtttatgagcagtttagacgactttatcactctggacgacatcgagccttcgcgtccgttctctacaagggctagtatgattgatgagctctattatatctccttgccgatcatcaatgaaacaatgggaaatgaggatagcgattggcgagtgtcagcgcttgccttagaggcagttgcgctccaagctcaggaactgcgcgaagctttccgcactgaacttatggatgcattatatcctgttctggaacgtctagcgtccaacaaccaagccctacaaaggcatgcaatgacgtgcctcaatgtccttacacaagcctgcggttacccagatactagcaccatgattgtcgagaacgtcgactatctcgtcaactccgtggctatcaaactgaacactttcgatgtatcgccatatcctccacaagtcttgctaatgatggtaaaattatgcggagcgcgacttgttccttaccttgatgaccttgtggactcgatctttgggatcttagacctttaccacggatacccaaagcttgttgaactgatgtttaaagcactatctgcaattgttgaagaaagcacgaagactccctcaatcctagcgattgagaatggtaccgggaatgcaccagatcatctgaaacgaaaatatcaagaactaaacattcatactcttgcggaagatttcgctcgccgaaaagccaaacgcactgaagatgccgggttggcaggagataatggacttctaaatcatccaatccggccttgggctgaagaacgcgaagataaagccccaaaggacatccctgacagcgactctctgtcggatatcctgggcaaagatgaaacggaggagccattaccaccacctcgtgaaccagaagatgcagaaaaacccctaagcaaaacgcactcgcttctcctccatatagtcaaatccctgcccttgcatttgtcctcaccatcaccatatctccgtcgatccttgctctccatcctcatcgacgttctccccgtcctcgcagcagacgaaaacagtttcctcccgctcatcaacgacctctggcccgctgtcatatcgaaaatcagtttcccttcttccatcggcagcacctcatcgtcctcatcaacagccctactaaatctagggaacgatacacctgacgagagcgctggcgctcgcaacaaccagcggggtcaccagaaacaggcgggtcttaacgacgaattcgatttcaaggaggagacctttgtaactaccaccgcctgcaaagctgtcgaaacaatgttcaaatcagccggagattttatggcgtcccgcgtcgaggctgcattcccacgctgggagcgcatatacaatcgcgcctgggaaaaagtttgtcaggatacggacaagattatcgaacggcaacagagacagtatctccttgaagactcaaatccggacgagtcttcaacagtactatctaccacacaaccacaaaagcgctttatccaatctctctccctagcaaaagccggctcatcatccggctcgcgagcgtttacaccgcaccatatcctctggcgagcgctcatctcgctctttctaaccatgctttcccacgtgcgtctgcctctagcagtcggcgatcgaatctgcctcattctcggtgaatggatagctcgatacgcagggacggggtactactcttctcgtgcggcgtttctattaaaggataacgatagtaactgcgctggcgcggaggaagaaataaactcgattgagaccgccattagggctatggagacttggaactccgatttaacttggtttatatttcagcagcaagatgtcaggtttcgagacagcatggggccgaggaatggtgcaagggtgtgtgagcagtcattgcaaaacaacgattcaggtgctgcactgttgagttcggtggctttcaatggaggtcggcttcgattcgcggagatgaatttttag

SEQ ID NO: 340 - DNA, 606 bp, Cladosporium fulvum
  misc_feature (414)..(414): n is a, c, g, or t
  misc_feature (519)..(519): n is a, c, g, or t
  misc_feature (544)..(544): n is a, c, g, or t
  misc_feature (547)..(547): n is a, c, g, or t
  misc_feature (571)..(571): n is a, c, g, or t
  misc_feature (580)..(580): n is a, c, g, or t
gagggccacaccgcgtgcaccaccaccgccgccatcaccaagtccttcacctgatcgcagcgtctgtgatcagcatcgaggaggcagcccagcatgcctcctccaccgcacacgcgccctgagaatgttctcaagcgcgcgcaggaactcatcggcgtgggccagcagcaggcggccttgtccattctccacgaacatgtcacctccaagaggacgcggaacagcaccatcgcggccctggagccggtgatgctgctgttcgtcgaactatgtgtagatctgcggaaaggcaagtctgccaaggacggcctctacaactacaagaacaccagccagaacaccaatgtcgccaccatcgagctggtcttccgccgcttcatcgagctcgctgagcaaaaggtcaccgaggcccanacaaaagcagacgagatctcagcgcagggcgccaccaccgagactaccgatcctcctggcgaacgtaccgatctggaggccatggaacaccggagtctatctctnttacagtctcggcgaacagtaaaanaanaacagatcggcaatcgtaccccgnggttaagtnttggggaaacataccgacagtttggt

SEQ ID NO: 341 - DNA, 766 bp, Cryptococcus neoformans var.
aactattcaatttttcgacatatcttactcgcaccaatcgatatcttccgcatcgtttttatagatgggtatcgacatccgccgccaccacgtcaagaagggcaaccgatctgcccccaagtctgaggacccctatctcctcttgcttgtcaagctctaccgattcttggctaggaggactgactccaagttcaaccgagttatcctcaagaggttgtttatgagcaagatcaaccgaccccccgtttctctctctcgaatcgtcaaggagaccaagaactctaaccccgacaactccaagatcgtcgtcgtcgttggcgccatcctcgacgacgagcgtctccccgaggttcccaagctctctatcgccgctcttcgattctctaccgctgcccgggagcgtatcaccgccgccggtggtgaggccctcactcttgaccagcttgctctccgtgcccctactggttccaacactgtccttctcaggggtaagaggaacgtccgtgaggccgttcagcacttcggcggtcccctcaagggtggtaagccttatgttgccagcaagggcaggaagttcgagatggcccgtggtaggagaaagtccaggggtttcaagatcaagtctactcacaagtaaacttttcgcggtcacaggagctagagaagtgttctgggcgcgagtggcatacgtggtggatctggcagacgcagcgctatctggtgctgttgggatgttacgttttcctcatgcaccatattccgatta

SEQ ID NO: 342 - DNA, 685 bp, Phytophthora parasitica
atcaagtttcaattttaagactagcaatatgggtattgatcttgtcgctggtggcaaggtcgtcggcaagaagaaccgcacgaaccccaagtcggacaatgtgtacctgaaccttttggtgcgcctgtaccgcttcctggctcgtcgcacggacgccaagttcaacgacatcgtgctccgtcgcctctaccagagcaacaccaaccaggctcctctgtccctgggcaaggtcgctcgcttcatgaagaagcatgagggcaagatcgccgtcgtggttgccacggtcacggacgacatccgtcttctgagtgtgcccaagctcacggtttgcgctctgaactttaccgaggcggcccgtgcccgcatcgtcaaggctggcggtgagtgcctgagcttcgaccagctggctctgcgtgcccccaagggcaccaacacggtgcttctccgtggcgcccgcaaggcccgtggcgtgtacgcccactttggccacaagtcgacgctcgagtcggtgcacacgcacgaccacgtcaagccgtacgtccgcagcaagggccgcaagttcgagcgtgcccgtggccgcaggaaatcgcgtggcttcaaggtgtaagcggcttagccacaagcacactgaaaccaggcttctctgtcttgtacttccagacgtgggtggtactggaggtttgtc

SEQ ID NO: 343 - DNA, 3975 bp, Aspergillus nidulans FGSC A4
atgtccctcttcactgatactgatttagcagcttatgcctcattatttatcctaatctacacactatcagacgccggggtcttcctcttcaacgttttcttcctcgtcgcacgctcgagcgtgtacttccccttcgcctttcacttctccaagctcgcgctacccctcttcaagcttctcgtagccaggatggattacaaggcgagggacatactttcggtgctgaagaacgtcaacctttcggttgatgccaaggtgacccatctccttggcttgaagtccgacatcaagcaaaagaatgttccggagaaggctgtgcctgtgatctttgagtgcttgcgacatgcaatagcctcacccttccacgccctttactcggccgggttttcgacgctcggccatttcttgaaacggctgtatattcaagaacaccaccaactggtcgccgccatgtccgaccggatactccccactctcgttgatcgtatgggtgacaacaaggaccgtatcagacagcagactacccatgccctggccgacttgtgggagggtgcgggcccccaaattgagaatcttgtactcagcgttggcttccagggaaagaacccttttcagaaacagacttgtctcaatttgctatccattgcgtttacacgttcagaaattactgccgcttatgcagaagctaccgccaaagagtatctaccacagattatcagttttgtcgaagatgccgatccgactgtccgccaaggggcgagagcactactcgtacagatgttcatcggcgaacgtgactctagcaaacacgaattgaagagagcacttgaacaatacaaggttaggccgtcgcatgcgagggagatccttgctggtatcggtcttgacccggaactttatgacgagagccactcttcacgccaacattcaatccagcaaagggcgccctcccgagctgccaccgcctctcgcgcgccatcgcgcgccggcatttcgcgtgctccttcgcgggccgccatttcgcgggctgcttcacgagccgatatttcgcgtgctccgtcacgagctgatacgtttgatgagcgttccggatcgaccactactcatgtagattctagctctgctgccgacgatggcgctcctgtgctgcatcaccccaagccggtccgaacatctcccgtcactggcggcatgattgctgcatcggataatcgaattgccgttacagattctattcccgccaacgattttgattccccgaagcagaagaacaccttgagaaccaacgcaagcaaagcatctggaatggtgaacgctccggctggccacgcagctgctccttcagcccttggacatgccgttgagaaagctaaacgcgctgttgagcctcttgatattgagccttatgatctcagctcttctcaggaacttgatcggctacaggctaccatggctccttggtttgagggcagagagactgaaatgaacttccagaggcgtgaagagtacaccatcttgatccgccgaatcacccatggaaatgcgccacagagatggcctacggcatacttgggtttcgtcaagatgacgctcccttttgtctttattacggccaattccgttcggacttctctgcaaaccgctgggcttcgggcagttcagtccctcgcccgggtcaacaaagaacgactcgacagctctattcacatcgtcttgcagaacgtcttgaaactctgcgcaaacgcgaagggcattacttcccaaaacagcaacttgaccatcgtcgctatactcgagaatgtgacctgcaatcaacgcgtattaaaccagattacgggcgccgcaaaggataagaatcagaacatgcggatcttctccgcgggttggcttgaaatcatcattgatggccaaaatcgccacaagactcacgccgaaggcgtgaacagcatcgccgcgtgcatccaggagggcgttgaggatgcgaaagaagacattcggagggcttaccgtcataccttcttccggttttccagcgtctggccggcgcgagctaaaaagatcttggacgcagtttcgccaaaaacacagaaattaattgaaaaggacatgctaaagatgtcggaggatccgtttgtttcgaactcgggttcctcggcgacggggctatttagcagcacgccagctcgtgcggccgcgaagggggtgactactgaaaaagggaaggctagtattgctgttcctaaagccatgtcgagtcccaaattggcatcacgctctactcaacctgtcacgacgaagaccaatactctacagaagaagcctacatcaaccttgtcatctgcacccatgcgaccaggagcggcgaaaccgcgtccagcgaccgcggccggatttcaactgaagaaaaaggagaacgagagtccacgaaaaaagcagaccccaagccgggttcctgaaccaggtttggataccccaatcactcgtcgtcgccagaacagcgaccccactcaaaatgagagcccgacgaagagtggctgggtagcgcatgccgcagatgaccatcacatcggcccattgactattccgaaaagacgctcaaccagagacaccgaaacacctcgagcaaaagccagcaagcaagcagatatcgaagtagagatggacgacaagaattacgatgggagggccgatgagatagtccaagagaaggtgaatgagacggtctatgagaccgtcgatgagatggttgatgaaagggccaacgagagggtcgatgaatatttcgatgaacatgtcgatgaacggatcgatgagatggtccgtgaaaaggtcgatgaaaaggtcgatgaagaggtcgatgaaaaggtcgatgaaaaggtcgatgagaaggtcgatgagaaggtcgatgagaaggccgatgagaaggtcgatgagaaagtcgacgagaaggttaatgagaaggttgatagtgcggccgatgacaatcttcaggaggaagtcgccgaaaaacggagtatgtctttgtccgacgagataattgcgtcggcccaacggcccagtgatgaggttaaggagcgttcttcggaggcggagagggcatctatgggaaagggaggcagcccgcgacctgagcgcgagtatgtcgattcaacgattgtatcggagtctccccttccaaagcgcgctgtgtccctctggtcgcagaattcgattaacgcacatgggatcctcttgaaaggaattgagcgaattcagacgagaactatggcgacagatggataccgaaagctccaggggctgattcagcatcatcccgatctgttcgctgatgaggagcaatttgctgtgttgttgattggtttgcttgacgagttggcggaacagactccaccgagcaagagtgtgttatctttgggtacggtgtcggatcacaagacgcaggttttgttcactgtgaagtacatgtttgagaacttcaagaagttttttgcgcctcactaccctggcacagttgtggcattgttggaggcagagaagtcagcggagatgggcggtcacttaatcaaggccattgaaaactttattgatgacattgtcaatgcttccagggcacactatgagatcattggcgccgtcgttacccatcttggtcctgctgttcagaatgaggctggccccactgagcacaggatgcttcgaaagggcttggatgttatcacacacggccttaccagcatgaaggaacgggaatgggaacttccgcctgatcagttagagcgcctcggagaatttgtgagacaggtgatgacgcttccatcggtggccctgaagcggaggatcttcgccctttgcattgctctgcgcgagctagtggacaacgaagagcgattctgggaacttgttggatcgaagacaaagggtgtcgacggcctcctattctactaccggacgaggcaggaggcccaggctgcatag

SEQ ID NO: 344 - DNA, 406 bp, Paracoccidioides brasiliensis
ctttcacgagggttagcgagatcaacttggaagaatggatagtaacagccttcgaactatcaaacttgctcaactcgaaaaggagaagaatgaattgaacgatcgtgtccgaataaccgccaaacgtattgaccatttggaacgagcttatcgtcgggaagaactaaaatatctgcctgcggattacgatgcacagaggaaacgtgatattgaaatctacgaaaagaacaaggcagataccctggtcgctgccgagctgaagcataaggaagatgttgctctcaagcatcgcctaagtcgtctggtgccctgctttaacgaattcagaaagaacctccaagagaaacgacatgttgaattcgagaagaatcgcaaagcggcagaaagggagttcgagaacaagaag

SEQ ID NO: 345 - DNA, 3633 bp, Ustilago maydis
atggccgatccagatgccatatacgagctggcgcaacgcatagagtccaacattgaagtcgacaagagagtagctgcgctccactcgttacagtctctgctagagtcagccggccatgtggtcgaagcagacgccgtcacctcggcagtcaaagtggcactcaggcatgccaatcaggcacttagcaccgcctcactttccttcattcccacgtatgcctccatgatctattccggcgatgcaacagattctcattcgctcctcaaccacaatgtccgcatgctcgtcaactcggttggcttgctcgtcatcgacaaactcggcgatcagaaagaacgcatcagggaagcggcccgcactgcgctcattgaactcggtaatgctgcctatgccatcagctcgggtcatctaaccacctcgggcaagggcaaagagacagagacaccgctcggcatcttcgaacgcacgctacgagaggcaggtctcgccgccaaatttgcaagagttcgagagcagtccgtgttgctgctacctatcctgcggcagagctgcgaaaagtaccccatcaggcctctcctttccaccaccgttgagctgctcttggacgccgatgctacggttagagaaggcgctcgctcaactttgataacgctgtttagtagtgcaacgccagccgcaaaagcagatttgaagaaagagctcgagaagcgagccgtccgcaagcagacagcagacgccattcttcgtgaggttcttggcgcaccatccgcagcaacctcggcgcccgtgctcagtccaccagcaccaacaacctttgccccaactacacgcagccaattcaactcgtctcatggcgctgatgcctccataccgacctcgtacatgaagtctgcgcccgctgcaggcaccactttcccatccatgccgtccgcatccgccaccgctgcagctgacggcattcgtccggtatacatcgcctcccgatccgacttggaacgcacgttcactaccatgatgccattcttcgaaaataaagagtcagaacataactggctcaaccgagagcagtccatgattaagatccgcggtctcctagtttcgggtgctcaccgtcagtttggcgagaccctttttgtggctcagctcaaagctgtccaagaggggatcctcaagtgtatctcaagtttgcgaacaactttgtcgatgcatgcgattcatcttgtgcaagagctagcgatggagctcggtgacgacctggccccctgcgtcgaagccttcctgatacatctcgtcggtatggctggcttcaccaagaagctcattgccaacgcaacacaggaagctgcagcagccatcatggtcaacgtcagcttccgcccactctacctgcaactgatctggcaagctttccaggaaaaaaacgtcgccactcgtaccgctgccgccgaacatctttgcactgttcttaatacgcatgctgcgcatcgcaagcatgctgtcgagtcgcatggtggcttggacttgctcgaaaaatgtatgagaaagggcgtcggtgactcaaatcctgccgccaggaccaagagcagggaagctttttggatttttcacagacactgggcagctcaggcaaatgccctcttgaactcgctagatccagccatcaggaagcaggtggctgccttggcgccgtccgacgtagagactgatacaattgtcgaacagcagcccaaggctgacggtggaccagtgagagtcagacctggtggggcttccatggcactaatccaagccaaaaaggctgcagcactcaaagcggcgcaggaaagggatcgcaagaaagctgaagatgctgcggctgcacacgaagctcgtgtcgcagctgctcgagctgcgttagctgagcagcagcagcagcagcagcaggtccagaagcatctggagcaacaggcatcggtggaagactttgtcactcctgttgctgcaaacaacaagaaaggcacagggttcatgccaatcaagaaccgcagcctacatcatccagggggtcaaggcgcaggcgcagcaaaccttaaaccggcgaccgagctgacggtagtgatcagcccgacggcacatcagcgcatccagacggctatctcggtccccctgcccacaagtccaaccccggctgttacacctaatgctaggatcaagagtaaaaatctgtcgcaaactagctgggaaacgcctccacaccctcgttcgcctggtctgagtccggtttcggctcgcagtcgcgcgatatcttcgtcgtcatactcatcgcaaggttcatcgagttcggctcgcatgcaaggggctgcgagcactcctcgatcgaatcgtgcgccaccggtaacgcacagcacgctgaaagccgacctggagaacctcagcatcgacggcatcgacggaattgacgatggagaagtgaccgctgacgcaacacagcaagctcggtttgctacgagctcgcgagacaacggcacgggagaagacgatacattgcagatgaacgctccggaagacgcatcaatggatttgatgggcatggacttcaattcgcccttcaagatgcccgcttctggtggacgagctgtcaagacgcaatcggtgcttttggaacgacagaatgcgcttgatgcgttgcagcagacaccacagccaaagtcgcatcggactatctcgacgtcgagtacatcgagtacaaattcgtccacgactccggcgagtgcctctgttcgtcgatccgggttgccgaggcctgtgtcaacgatgcattcgccatcgccatcggcatcggcgtcgcatatcagcgcgggacacatacacgccccaacgacgagccatcgtgtattgtcatcgactccgtctcgtcgcgcgccgacaaacggcgtcagcacagcactcgagaatcgagcaaagcggctcgatgctcaagcgtcgacagcgtcggcctcaccggcaaaagctaaaccagaagtctggacgtggattcaagcgctgatggacggcacggcggatcttcgcacgttccgaagattggcgcgcctatccagtgagtttggcatctctgcgaccaaggcagcagacgagcgcacggagcaagacgacgaaatggtgcttgaacggggaccgtttagcaacgtggcttgggcgaccaagtcggacggagcgttttcgagtggattgcaagcatggctcgaaggcgggcttttcggcaagcttttcgatggtttgaagcggtatctttgcgtcggcgatgggggaggcagtggggaactgcagatgagtgcgcaggtggtactgcttcgattagtcgaaaaccaattcagcctgtttggcgcgacagatcgagagggtgagctgttggatgtggtgttgcaatccatcacgctgctctgtggtactcgcacgtcgtgcgtggcgtcttcgtcgatcgtagcgggtagagcggctctgcaaggatttgaatccatccttggcgcatggtcgggacgctgcgatccggtcctcggattcgacgctctgctctctcgatcgctgtcagacgcgtcgacggtagccgtcctccgctcaggtttcactccgctccttatttcctcccgcgtctag

SEQ ID NO: 346 - DNA, 3912 bp, Candida albicans
atgctgacaacaaagtttaatagcatttctcctattgaattattggaaataatatcttcctatgatatccaggatgaaattaaattgtcacatatacaaaatttgaaaactcatattaagaaagataccattgatttaagaaatgtaccaatttatttacaaataattactaaaggattggagattactcgtttaaatatttcttctgtcagttttaattcgctttcttaccttatcaagagaataagtgttcaagataaatcaggtaacattttaaaagaagaatgctttttaattttaccaattttaatcaacaaattaggaaatgcatcatcaccagctggcaccaacctggccaagaaatcactagaagactattggttatcgagtcctattgaagtcgaggatgcattgacggagattgcttttgaaaacccaaatactaaaattaccattgaaaccatcgattggatgacccaaattttgaaaaatataagtgccaaattcaatgtaccgaaattcttaccaaagattttgcactcaattgaaattaatccccataatgaggagattattgtttctactaaagagttactttctatttaccttgaaaaaaatccatccgctatagaagggttcaaaaagcaaatagaatcacacctgttagcacaagcaaccaaagacaaacttttaggtagtgtcatttctaaacttcgtggtagtgacccagaacctcacgtacaaagagccaatacaccaagactgaacacaccggtgtcccagatacagagcagtttagttgatgttggtcatgacgttgaattacttgaactcttaaacaaagtcaattacgaaatagacagctccattaaggctctcgacatccgtgatgcaaatagtttattcaatacttttgaaatttttatgccttgttttgatgggaaagaaacagaatcaaattggaaagtaagggaaaaaaatatcttgcaaatgagatcgattttacgtgggaatagtgctacacagtttagatcagaattggttcagtgtattcatactatagctaatggaatgtgcaaaggagcaagctcgcttcgtactacgttaagttccaacagttgtcaattaatcaaagaatgtgccgtgattttgaaaaaatcattagagccagtggctgagagtcttttccccacgttgatcaaactatgctcttccaccaaaaatattgcctccaccaatgcaaatatgtcggttgctgcgttatacgctaacttgccgtatacttcaaaaatgattcaacgtatcaccttggcatcagaggatagaaattatcaacctagatcgtactctttgatttggttgcatattttattgttaaagataggaatagaccgcagttatattggacatcacgattccagttttattgaagcagcaaacaaggtgtttatgaaacttttgaaagatgctaatcctaatgttagacaaacagccaaagaatgctattggtgtttcactagagttttccctgaagacgcagaaagacttttaaaacgactagaaccaaatattgttagggcacttgaaagatctcaaagagaaagtggcgggtcaggaattgcacccatcagaaccctcagcagtcgcccatctcggccatccttgaaagaggctatattagagaagaataaggaattgcgtcaacgaagaccgccttctcgtaactcgggtgagcagtcaacaaaaataaagtctgtgcctttgccaaggccaactaaaagcagctcacgtttggagaagtcgttactcaggccagatgttgggcataagagccagccagcagtgagagcatctagttggacatatcctagcacccaaagtggtcccaaagccactttcaagcaaagagaacgtagtaaaactgaggtgcataaaaaatcgccacttgaaatctcgaggccgtcgagtcgtttggacaccggtgctgtttcttctttcaataacaagaacgatcccatgatcaactttttatcgtccagtgatagtgacttgataaaggagggtataaatttattaaaatatgcgattatagggaaagaaaatctaccatctgaaatcaactccttgcttaagagcatttctgaaaagcatgttcaatttatgaaaccacttttcacgtcaaatgattatacttttaaaaaagcagcactgttgttacttcctgatgatttcttaagagtttgtgcgttggtttttgatgaatttgatgaggctgttatcagcttgattattcaatgtatcgatgttctgactttttatgagtcagcttgcaaccttttaacattggtggcagataccccaaacatacctggaagtcatgcccttgtaatgcagatatctaaccaaaagttgactataacgaaactgattttacaggcgttgctgatagctttgagtaaacatgcagttactgacgttcagtttggagaaatatttcaagagcttgtcaaattgattattgtattgaaggcaactgattattattcgctcctttgtcagttgtttcgtcagttgtatactattgacagtaacaagttcagtttgttggtagaagatgtcgagggcaagcttaaggaagaagtggagtttatagttggtattgagagcactatgacacttgaaagaccgtcaagcaaacttgattatgatttgactgtggttaagccaacactgaatttaggtactttcgttctatcccagaaacccagtgctgatgattttactatgctattacctaagagaagtgagtttttgggtagtggagaggtatataattcaaagatggtggcaaagatagaagctctggattcatcaccacagaagcagtcgcaaatggaccaaatctctctgaaaagatcaaactcagaacatcaatcggaagtattggtggatgattttgccaatgtttccatagcagatggtggtggttccaaattaaatcaatcgaaaaatgatgacgataatttgaaacagtttatggaaagaattgatccattgaaaccaatttccaacaagattagaaaaatctccatatacgaggatgctaagcagaattcagaaaaacccaaattagaaagaaattggggtggatttcagtatgccaaattttcaagagcaattcgtgttaatgcagtcgcagagaatatgagtttgactagtcaagaatttgaaagttgttgctcaaaattagtggaaacgccttctcagtctgcgttattgaaaatgacttggtttgttgattcattgtcagtttccagctatgactaccaagaattttttcttaacaaggggaaacacaagttggagaaatcgttatgggaatttttcagtaaaatcgataaactggatcattcattggttatgaatggattattcttgttgaaacaattgttaaaatttaatgacactcccaatgttgataaattatttgcacttttagttgatacttgctctcaagaagaattggatagtgaattatactttatatggaacgaaatgttgttaagtttaaaccatgatgagttaatgaaatcatttgagaaaaatgccttgaactatttagaaggagaagaaaacaatttgactattctgagtttatgtttgaactatttagccaaagtgttggtcgatgataattgtttggatgttgcaaaaatttatcgcttagatactatatttgggaaactatttcatgaacgtgaggtgatgtttcggaaatcagcaacaatctgctatagtaatttattgaaaaacactaatgtttctcctgaagtgaaagatactttggataaagtcaaatcaagataccctgcttctactcagaggttaattgagttttacatgaagaggtaa

SEQ ID NO: 347 - DNA, 686 bp, Phytophthora infestans
tcactatagggaaagctggtacgcctgcaggtaccggtccggaattcccgggtcgacccacgcgtccggccctacaagcgctagtacagggcaaagtggccagctctctaccgaccaacgtggggcgtcagaagagcgccaaggagacagccaagtacattcgctatacacccaacgaccagggcacttcaggcgtctcgaagcagcggattatccgcatggtggacgtggccaaagaccccatggagccacccaaattccagcacacgaaggctgtgcgaggtccaccgtcccctcccgttccagtgctgcattctcctcctaggaaactcactgtggctgatcagcagtcgtggaagatcccgccgtgtatctccaactggaagaactcgaaaggcttcactattgcgctggacaaacgtctggcagctgacggccgaggactgcagcaagtgactgtgaatgacaactttgccagtttgtcggaagctctggccattgcggagcgtaaagcccgagaggaggtgaatatgcgcgctcaggtgcagaagaagctggcgatgaagcagaaggagcagaaggagaacgagctgcgcgagttggcgtccaaagcgcgcatggaacgcgctgggatccgcgcggacagcgacgacgaagaggatcgcagtcgtagacgtcgctcctcc

SEQ ID NO: 348 - DNA, 784 bp, Aspergillus flavus
ggcccgaagcttgcacacggctgttacttcgaccaaagatggccagtcctgggccctcccaactttccattctgcaataattgctctctggcttgcggtatatggtggatgggattttgacggaccgtcgtccccacttcccggggtcgatctcgagaaggacgcagaggagcgcacaaagatgttcatgacagcgctggatgatggaggcctggacttcatgctggctgtctgctctggtgtgaacaacgaagaatgggcggatccagctcggagtgaattggttacattgctattgaaggaaagctcctcagctatgcctgagtcggacacttgcgccccctacatgaaatgcttactgatggagaacttcgaagtctttgtggagtcatgcattgctaatatgccggatgctgttcggatgttgaaatctgaggaagactcgcaaagattggatcagattactgcgcttagagatggcctaacttctagtctccatcgaggtttagtggaagctcggacacaccttgaatcattcctcatggtaatggctttcgcatttgagcagcgaccagacgctgcacaggagttttgggccgatcctgacggaaatctgtacggcttcctttcatgggccctcgaaaggcaactgtcccctagagtagcgcattctgtgaattactatgctctatttcgggcagcgaagataatgccactgcagctcatagatccctcactgaagaaagacaagttatgtctgctaaattcagcggtcgactctatg

SEQ ID NO: 349 - DNA, 3413 bp, Cryptococcus neoformans var.
atgtttgacactcatgaagtggcgacagtccatgagcgctgcggaggggaatgtcgaaagggagggtgtggacgaggagggaagaaggagaaagagaggaagaaagaagcggtgtggatgagaatggggatgcggctctgcggcaaagaggtgcgcacagaccgctacagtcagcgtcccgaagacggagaggggagatgtccggtggatcgggacagagtggaggcgaggggaggggaagattcttgctcgttcctgtactatttatgtgaactggtcgtgcaacggtcgtttgctgactcgcccgccgccatgtcccccgccccgcccccgccccagccaagcacctacgcgtcgaagcacccggagagcaccccccgtctccttagtgccctccgcgacctccacgccacagaccccaaggccatcaggaccaccgtacatcgatacccagcagctctgtacgcccacgggcagaatgagcatgccagagaccggctcataacgagctggaagatgacagagcatatgtacttcaaaaagtccctcgtatttcccactcttgctagaggcttgtttaccgaagaagtactggaaggagaccctgtacctcctttggaagcatgttccggccagatcggaagtgacccagatgcgcccagggagagaatagtactcagaggctacgacaagttctttaatactggcgaagtctcatggactgagtgggacgcgatgaaacaacacacccagggaccgtattaccttacgctcaaatccaatggttgcctgatcctcatatctgcgctttctcccacccatctcattgtggcctccaagcattcccttggcaccaccacagctgctgaaggcgtcgatttgtctggttcagagaaactaatcgacaaggaaaagcctgcccaaaaatgcggagactcggccttgggaccagaaatcagtcaaattcgcaccataccgtcttttcctccgacagttggatcccttgataaacattttaaagaccttactctcgaacaatcgcaagcgaatcaatcactctcaaagaacgctttgaaaaaggccgagaaggctgctttgaaatatgcacaaaaggtgataaatgagggcaagtcggaggacagcgctcagattactgcagctgaggaaaagaaggagataaaggagaatgaggaggcacagcaacacgcagaggtcggaagacggtggttaaaacggacgttggaatccagcgggaaaacagaggaagagttggcacaaaaactctgggagaaaaacttgactgcagtgcttgagctttgtgacgactcatttgaagagcacgtgatagccactcctgagcattggacgggacttcacctccacggcctcaattcaaacaccccgcacttttccacttcctcaccatctgatgtggcgacatttgcaaaagagtttggattcattcagaccaaatatatccagctcgaaaccctcgaacaagtcaagtccttcacagccgatctggcacaaagcggcacctgggaaggtgaaatgattgaaggttttgtagttcgctgtacggttaaaaatgggcaagatggcatgagccagggcgcgcctccatatcgagccaactctccgtttttcttcaaaatcaagtttgaagaaccatatcttctctatcgccagttccgcgagataacccgtgtcatgttacctctgttggagaacactaatccccaaaaaagagaagaaatttggaaaaaagtacgttctcgggcgaagaggccagaggtcaaactttactctacatgggtgggcgaaatgatgaagaaagagcccgaactatttgaagattataaccgtggggtaattagagtccgagaaaggtttttgaaatgggccgaggaagacggcaagaaaaagtgggatgatgcgagggcgggcaagattgataaggagcaaagggctggcgatcgggatggactaccaaaaaagtggatcgtagtacctgctgctattcctggttgcggtaagatgcccttttttccaaacggcagaatcaaatctaacgttcttacaggtaaaaccctattgggtgtcgccctttctagaatatttggtttggcccatacgcagagcgatgacattaccgctaaaaggaccgcacctactttcatcaaaaacgtgacggatctccttgccacgtacgacgtcgtttttgcagacagatgtaatcatatccccaagcattacgacgaactcgccaagatcgcagaagacaaaaagcttcaaaaattcgatacccgtcttatctgtgtcacttgggaccttgataccttcccgtattaccgccttcttcgcattctttctgatcgggtggttgcccgtggagaaaaccatcagactctgaggcctgatcctacccttgatgcggagcacgaggcggtggtaggcaggttcattcgagactatacaccacctgatcctgccatctttgaggatatcatcagcgtcagtgtgatggacagcgccaaggttacattaacaaaggttgtacgaggtcttacgaaatctctcggtttaacgatgccatcggaagatgtcatcaaccaaggcctagaagccgcaagtctgtacaagacgactacaccatatcatcccgtagctcggcagggcaggtctactcgctactttgctgtggctccagaaataaatctttacgaactcgcctgcggagctatcgaaccctttagagatactgaaaaaggtcaaagtgcttggtcgttcttggacgagttgtataaacgtgggaggattactgctaaaccacacgttactctatcgcacgagaataacgtaaaggctgaaatggaagttagaaataggactggagcacgtgaaggtagggatgactcagagcttgctcagtctcctgggccagaagagattctatgggagacttgcaaatccatcgccacttccaagtaccccccgctctattcattttctctcacccaccttgtatgggatgatcgtactatggcattttgcctctctggcttgtctcccgtaatcagtcctacaccagatgaaccagatggcgctgcttcgccatctttatgtcccgatctggatagcgtgttaccacaggccacgaaaacatatctgcatgtgacagtcggtaccagagatgcggacgtgccagcttttgagagtcgaagcctagtcaagattgtcagagaaagattggaagctggtgagcaggaaggagaaatcgaagaggtcgtcgcaaacggaggaaatgtaaagtggatgaaaatcggcctggccaggagcgaaggcaggattcgaggaatggcctgaaaaagtaggcactataacgcaaaaggcttaaattaatactcattata

SEQ ID NO: 350 - DNA, 431 bp, Phanerochaete chrysosporium
accatattcgcaacaacttccccctccgcccaccatctgccgcctcttggatccgacggtcactcgcagactcgttgcgcagccgcaagccatattctgtcaatcttctcctcggcggctatgacatcaacacgtatacacctcacctgtactgggtagactatcttggcactctagcggaggtgccattcgccgcacacggctacggaagctacttcacgctttctctccttgacaaataccataaccccgaagcggatgtagatgaaggcatcgccacgctgaaacgctgcatagacgaggtgtcaaagcggttggtagtatcgcctgaccgattcaaggtcaagatagtggacaaggatggtgttcgtgagattgagctgtaatggtttgcgaatgtatattacttccactcttcttctacaacgcgt

SEQ ID NO: 351 - DNA, 1001 bp, Paracoccidioides brasiliensis
  misc_feature (44)..(44): n is a, c, g, or t
  misc_feature (47)..(47): n is a, c, g, or t
  misc_feature (59)..(59): n is a, c, g, or t
  misc_feature (77)..(77): n is a, c, g, or t
ggatgaaagcgaccgcctttattaccgattactacttctcgtgnccnccggagttattngatttctggtacgcaganagccatgatgtatggcctgagcgaaatggacgtccaaaacggtggaagctctctcatatgtcttccaaagttacacctcatttacagagcatcaaatgccgttggtttttatattgatcggcaattacttccaagatgctctcatgtcaggcggaggaagcagcggcggcatcgaatgcaaggaatacttcgatattcttgcttctgtcctatcaaaatacccacgtctgttgcaaaattcgacatttgtgtttgttccaggagacaatgacccctgggcatccgcctactcggccggtgcttccacaacatcccctaaggatgctatccctgatctattcacatctagagtgaaacgtgcattcactaatgccaacaacgcacatcaactaccaaatacacgccacacaccgggaaaagcgatttggacatcaaaccccacccggctcagccttatcgggcccgataatgaactcatcgtgtatagcgatgatgtctccgagcgaataagacgtaactcgattgttttcaacctcaaaagcctcaagaggttccacaggaccagtaggaagccataggaaaagataaggaattgatctagagtacataaacaataacaagcacagactcctaagtgagatcaaacaacacagaagagcaaagacaagacatatgatcaagaaagcacatccacctcatcacaaagataaagctcagtgtcacgaaatacaaaagatctgacaaaataattccattacacagaatcgacatccctggatatgttgtcaaataaccctacatgcatgccaaagatgatgaacatgaaaataaaggtacaaaaaccagtgaccaagcaactttaatatatatgtacaggaaatcaatcacattaagaataataacaataagaacacccacatacaa

SEQ ID NO: 352 - DNA, 954 bp, Paracoccidioides brasiliensis
  misc_feature (780)..(780): n is a, c, g, or t
  misc_feature (954)..(954): n is a, c, g, or t
gcacgaggcagcaacaatgatagttaaaaatgaccccgtctgctacaaatggaactgctgcgataccagaacttcttgaagagctgaacaaagctcccgagggcgttgttctgcctcccagggacattagaagtcagtacttcacacctagactaccagagctgaacccgagggctgaacatagagccatatttggatgtataacttacatctttcatagctattatcgagaagaccgctggattcgtcgcccgtaatggacctgtttttgaagatcgagtacgcgaaaaagaaaggtccaatcctaaattctcctttttgagcgcaaacgatgcatactctgcgttttatgcgtggcgccttagcgaaataagggccggtagagggactgcggtttctgctggtcgagttggggagggggcggcaccggagcctgagaaaccaaagggtcctgctcaacccccagactatcatttctctgcgcgtatgccgaacatcaatgctctggaccttgacgtcgtcaaactgactgccctgtttgtcgccaagcgagggaaatcgttcatgaccgccctgtccccagcgcgaaatgagaaacttccagtttgacttcctccgaccgcagcacagtctatatcagttcttcacgcggcttgtagaccaatacacgggcctccttcaagtcggcgagacagatggtcctaattcgacgtcgagacgattgtcagagttggagcgaaacgttaaggattaatatcacgttcttgaccgagcggagcnacgcgccaaatgggtttaatatcaggagccacagaaggcaaaggagggggagaaagaggcgcaggaaaggttcgaataccccaaagtagatgggatgaattcgccggggcgagacacgtttctcccggggagatacatgtgaaatcccccccaatttcctaagagcccaaaggn

SEQ ID NO: 353 - DNA, 3438 bp, Ustilago maydis
atgccgcttgcagtgacagcgtccaggtcgcgcttggcagctaccaaggctcgccaacccaccgcatcatcctccgcctcctctactaccacttccgcacctggccgatccaagtcagcaacagcgcctcaatcagctcctattccacctccgccatcggtgctagagttgccatccccgcttcctacgctctcagagcttcaagcaacccacgacattcaacccagcccacaccttgttgctcgccgacttaactcgctcgcccgctccttccttgcattgcatgccgaaacagcgtcgcctgaccctctcaactgggagctcgatctgtgctctgctaccttgttctctgtgtacgccgtgtgcctagactcgtcctcagccattgcgcgtgccactttggctagatgcgctcgtctcggaggcttcaacattgtgctcccgttcagtccctcggctagtgcagcgtcagcgaccgtttctgcttccaagctcagctctcaggaccctcatgatgccgccggtgctcacgcatgcatccacattcttcagcaaggatcgtcagctactttccacgacgcagccagtgcccgagagtatcgtgatgcgtgtcacacgctcggcagatcgtccgacgctcttcaggtctctgatctgcttcgagacaaggcacttggcaagagaaaggccatggaaccagctcatcaagatgcctctttgtctcaacctgtttcgtcaaagcaccgttaccaatcccaactacaaaccgaccaggcgtacaatgcagccagtcgcgcacgcatccagcaagcacaaaccctattcagccaagcaatccagcttgatcctttcaactggcgcgcatgggcaggcctttgcgataccggatacggtgccgcctcggctaccaagcatctcagcgcttctacactagatcgtctttactcgaatctggtcgcaaaggtgcaggccccctacatagccaccgaagcttcgctcaagtccagcccgccattctcgaatgcacacgtcgaagcttctcccatggtccgcaaggtgtcggaagacggcgccaacaagaagctcaaggtttcttcagaagtccctgccgtgcctccgatgcctcccttgccggtctccgccgtccgcaacggcgtgccgtccaaaccaaccgacaaagtgactccaccgctgccaaccacgtcagccagcgccgtgacggctacacgcttgcatccagcatcgcgtgctctctcggccgcccagaccaacacacgccatctcgagcccgtatctgccgaaaaggacaatgtcaaggcagtcaaggttgtcgacaacgctactcggcccactcgcaccacaggtgtacgcactgctacagtcactgctcctaccaccacaaacgcacggcagttgcggtctacccgcggcaacacgggcgtttcgacagcggcgaccaccgtctcgcgctccgcagcagccccgatcagagcaggcgccacaagtgcagccggcagcgtctcttccacctcttctgcatcttccacctcatccatgtcgtcccgcgcaaccgtctctacggcgcgtaccgctgtgtctagccgcagagttgcgtcaggagcatctgctcaatctgcagcgcgcgccacagccgccaagcccacttctgcatcaactactcgcaccacaagcacaaccaatggcgccagcgttctgccaaagagggccatcaccgccgcgacgagtcgtctggctacttccggcaatcagagtcgtcccggtagcgccatgtccaaggcgagctccacttcggctggtggtgccggtataccagcgcgcaccaacggtaccctcgcttccagccgtacagctgccgaggcgatgcgtctcaaagaggagcaacatgccagagccaagctcgattcgctcaccgcgttgcgagagccgatcgtgcagcagctcacgtccatggcgcatcagcaagctgcagacagctatgtgctggctctgcttgctcagctcggcgaagcgtatcgactcttgcgactctgcgagggggacaaagctgcggctgtgttgatgggctgcgtacaaggtgagactgccgtcgtcgaggatggcagaacgcaggtgctcagacagaacggccacggttcagctgcaagcaaagcagccgcgtccaccgagatagatcgcttgctcgaccatcaaatcaaagacagcttgctccaccacctgctcttggcccgcagttacgccgaatgctcccagtacgcctctgccgaacatcactttggcgccgtaaccaaactgaaccctttcattgcgtcgcacatggacgtgtattcgcttgtgctcttccacctctctcgcgaggtcaagctgtctgcattggcgcaacaccttgccatggttgcgcctaacacggcgtctacgcacattgtcgtcggtaacgcgttttcattgcagaaagagcaccagacggcgcttgtgtgttttcagcgtgccgcggcggctgcgccagactacgcgtacgcctacacgctcgcgggtcacgaagcgcatgatttggggctgcacgatgaagcgattgcctacttccgcagcgcgatccgttgcgatcggcgccactggaacgcgtgggctgggttgggtcgtgtctacctaggcctcggcgagcacgaacacgctgcatgcaagagtctgcagcaggcgatccacctgaacgcttccaaccacctcctttgggatctggtgggttggacgttttcattgctcaatgcaccggccaaggcgctggagtgctacgatcgggcgatcgaactggcaccgcgggcgtcggtgttgacgtatctgcgtcgagcagagctgttgctgcaacatggagatgtggactcgagccatcgcgatctggtctgtgcgcacgacttggcgcccgaggaagcaagcgtgcatatcttgctcgctcagtcgtacatgcgtctcggcggaggtagcttttgccacatcgaaggcgctacggccaaagccaaggcgagtggcgtcatgatcttgcccgaaaagttccaagccgaaatcagccatcacctgagcgttgcggtagatctggaccctacgctcttgcgtctcgtcaagagcatctgtgaaggctacaagtgtttgcctgggagcaagctggtgcctaacgaattgtcgttgatggactcgatcacaatcgatgaaagccagccaagcgcgtttgcgcacatgcagcgcgagtcgagcaggctcgccaactcgaccgcgcaccacctcgtgcacgttgctccaggcgctctgcaacctccaccgccagattttgccagcagcctccccacgcacaacgacgcaagcagctggctccaccgcgcgaattccagcctggatatcgtcctgcacgacacagatgtttccatctga

SEQ ID NO: 354 - DNA, 660 bp, Botryotinia fuckeliana
gtggcctcgaacttcttgccgatgagcttgttacacttgccaatcccaaagagaccatcattaccattctcaactccctctccaacgaagaaatgacattggagggatgccgaaaatttagtatgggattgcatatacttaagcagacgttagatatcaagtcagatgttgagttggaagatgcggaaattgatagcatcttggaattggcagcaaagtgtcttgagagcaaggagagcggagtgagactggatgctgtggtactctgtgtgagtacgcatgcaagaattggagaggcaagattctggagtggaattggtggaagagtgagtggcgatccaaagagcttgatcacgtactacattgtcaagaggcagagggagctggaggtagaaaattgacggtgtggagagggacatgtaacgaaagtcagtggcataagctaatgtttcgtttggacgaacgaagggaatgataagtaggatcgttgtacaatacgaaagtcttttggtttgactggatatttttgggatattttctgggtggtgtggtggattctaacgtgtgcagcgagggaaaatgggaaggtgatacaaggcgttgtgcagtgcacgttacatatcaactttctgggtattggcagaggcgtaagagtttggg

SEQ ID NO: 355 - DNA, 581 bp, Aspergillus flavus
tgtgttttgcaatgttgaccgcgctattcggtcgaatgtcgaactagcacgatacctcggctctcccgacagtatcgcacggatagacacctttcgcaagcgcgccacgtcgacttatctggattcttggaaggagacttcgcagtacctgcttgatgtgcaatacacatctcggggtgccggtgcgtcaactagaccaacgtctggaggcattgttgattctagcgccatagtcaaatctctttcatcaaaagataaagacgcaattaaggataagttcaaggcgttcaatacaagcttcgatgaccttgtttctcgtcacaaggctctgtatatggagcgagaagtacgaggcgtcctgtctcgtgaggtgcagactgtgctagagccattgtatgcacgtttctgggaccgctaccatgaaatcgacaagggaagaggtaagtacgtcaagtatgataaggggagcctttctgcgcagctagcagcattgggataggtatagctgggtttaacccacatcctgatacttaggtgatgttggaggacgatgtgatggtttcgaatgctctgcgctgcgt

SEQ ID NO: 356 - DNA, 699 bp, Phytophthora parasitica
gagaaacaaaacaaaatggactcgatcttcggcatcgtgggtaaggacttcgtgctgctggccgctgactgcaaggtggcgcgcagcatcctggtgtataaagatgacgaagataagtccattaacctggacgatcacaaagtgatggtcacatcgggtccgcagagcgaccgcttggcctttggcgagtacattcaggagaacatgaagctctacgagctgcgcaacggcgtgacgctcaacggtccagccaccgccaactacgtgcgcggcgagctagcgcgtttcctgcgccgctccccgtaccaggtgaacctgcttatcggcgccgtggataccacgccagagcagaaggccgaccctagtctgcactggatcgactacctcggctccatggtcaaggtgaactttggagcacacggctatggtgcgcacttctgcctgtccatcttcgaccgcgagtggaagccggacatgacgctggatgaggccaaagaggtgcttaagaagtgccgcgcagagctcgacatgcgcttcctcgtgcgcaacggccaatgggcgtacacgttgattgacgcgagcggcatctcgcaggttaaggttgagtagtttgaagatggctacacaatacagaagagaggggtgctgcataattgaatgctaataggcacactttctgcagtattgaaaaaaaaaaaa

SEQ ID NO: 357 - DNA, 2319 bp, Cryptococcus neoformans var.
atgtccgctctcaaccttccaaagcccgttaatacctacgcgggtgaagatgagctaaggaatcccaatggtgtagcgggggtggcgaatggccaggcagttcaggagaatgaggatgccgaggaggaatgggtgccacccaaggcgagcgacaagctgaagattggcatcatctatcctccgaaggagatcagaaacatcgtcgacaagaccgcaatccatatctccaaatctcccactccccttcttcttgaagaaaaaatccgtgaacatcaaaagacagatcccaaatttgcatttttgaatgatgccgacccatatcaccaatactacaggtatatgattgtcaagtctcaagaggatgcggaggatgctgcaaaggggattgttaagcctcaagaagagaagaagatggaaaagaaggatgagggacccaaagcaaccgagccgaaaccctgggaattcaaggtcgaccttccaggcgtgactgctatggacctcgatatcctccgacttacagccctcttccatgcccgtcgcggccgctctttcctctcttcgctttccgtcaaggaagggcgtaactaccaattcgatttcctgcgccctacccactctctctatggctactacaaccgcatggtggagtcttatcaaaagatcatgcagccaccacctgggctcattgacggcgtcatcaaagaagcgaacgaccctgactggaagtggcatattcttgacgaggcaagaaacagggccgagtgggagaagactagaagaaagagggagaacgaaagagccaaagaggaagaagaagaggccaaggcttttgctgcgattgattggcaagattttgtcaccgtcgagacaatcgagtttactcagaacgacgagcaacttgaattgcctcctccaacatctgtcgagaaactcaaatccatgagcatggccgaaaaacgaatggcagccatggtcatggaagagactggtgctggcccaacgggcgagacagctccgcccgcggaagagatggaaatggaggaggacgaagaagaggaagaagccaggttacagaggatcaaagcagagcaggagcaggccagggcccgagaagtgcaaagggcagctatggagcagagaggtatgaagataaagaaggattatgtgccaagaggtattcaacgtacaaacgctgtcgccactgccatttgtcccaattgtggtcaatccatccctgaaaatgagctcactgaacacatgcgtatcgagcttcttgatcccaaatggaaagagcaaaagaaacagctcgaactccgacgggcccaagctcaacaactccaacagggtgccgatgtcgtctcctccctcaaaaaccttgcttccgcccgtacagatatctttggtgacgacgtggatgaggctgaacgaaagagacgagaggaagaagagaggcagaagagaagggagagggaaaagattgtttgggatggtcacactgcttctgcggccaagacggcggaaacattccagtcccaattcagcctcgacgaacagatcaaaaaattgcacaaccgtgctggtctcactgaccaaccttccaatgctcccggtccccagattggccctggcataacccaacaagcccacgtccctaccccactcgctgctggtttgtccacccccggaggcggtacagcctacgctggcgctaccatctctgccgcacctactggacctactaccaaagagtacatctcaactccgtatgacccctcctttggcggtacaccccctcctcctcctggatctgcgcccagtatccatccttcacgtttggcagccatgggtgggaacactccttatcttggttccgcaaccccgcctatggctggccaagttcacccgcgagcggaggatgaaggtgccggcgaccgaccggtgttcaagcgccccaagattgaaaaacttccttacggtcagctttacactgaaattgattggcaatctctccaccccgaacccatctccatcgctgtccagctcccttccatgcctgaaaagcctgaatggaagttggatggatcaatcatcaccgtacctgatctgcctgttagcacattgttttccacgatccgagagaggattagaagaatccttgatacggatgtgccgattagtagaatgaggttggattataataataagccaatgagtaactctagcacgttggcaagtgtgaatttggatgagggagatatgcttagcttggttgtgaagaagaagtagagtgtattttgtatgcaaaagatgggcttatta

SEQ ID NO: 358 - DNA, 255 bp, Blumeria graminis f. sp.
  misc_feature (40)..(40): n is a, c, g, or t
ggacaacagtaaatcacaacgccaaacgcttgtcgccagncgccaaaatgggtatcgatcttaacgcccaccacgttcgaaacactcaccgaaaggctcccaagagtgacaatgtttacattaagttattggttaagctatatcgttttctagcacgacgaactgattcttccttcaacaaagttgtccttcgtagactctttatgtctcgcatcaacaggccccctgtgtctatttcccgaatcgtggccaaca

SEQ ID NO: 359 - DNA, 688 bp, Phytophthora infestans
  misc_feature (673)..(673): n is a, c, g, or t
  misc_feature (675)..(676): n is a, c, g, or t
  misc_feature (686)..(686): n is a, c, g, or t
caaaaaacaaaatggactcgatcttcggcatcgtgggtaaggacttcgtgctgctggcagcagactgcaaggtggtgcgcagtatcctcgtgtataaggacgatgaagacaagtctatcaacctggacgagcacaaggtgatggtcacatcgggcccgcagagcgaccgcttggcctttggcgagtacattcagaagaacatgaagctctacgagctgcgcaacggtgtgacgctcaacggcccggccaccgccaactacgtgcgtggcgaactggcgcgcttcctgcgccgcgctccgtaccaggtgaacctgttgattggcgctgtagacgcctcgcccgagcagaaggctgagcccagtctacactggatcgactatttgggctccatggtcaaggtgaactttggtgcgcacggctacggcgcacacttctgtctgtcgatcttcgaccgcgaatggaagcctgacatgacgctggatgaggccaaggagactcttaagaagtgccgtgcagagctcgacatgcgcttcctcgtgcgcaacggccagtgggcgtacacgttgattgacgcgggtggtatttcgcaggttaaggtcgagtagttggacgatggcaccaagtgagggttgtgcaatgccaatagactcactttcttttaaaaaaaaaaaancnnactaaaaaanaa

SEQ ID NO: 360 - DNA, 699 bp, Phytophthora parasitica; identical to SEQ ID NO: 356

SEQ ID NO: 361 - DNA, 306 bp, Alternaria brassicicola
atttcgagcggccgcccgggcaggtactacagcaagctggccaagtcacattgaccaccgagggtaactatgagatgattgactacatcacctctctccgggagggcatcatggatgcatgggatggatgcattgttgccatgaagagcagcaacaagactcaactcattgttccttaccttgactcaattttcgaccttctccgcaccatccaacaggacaacaaccgcaccgaggctcttcttcgatcttcatgcggcgttattggtgaccttgcagatgcgttcccgactggtgacttcaggc

SEQ ID NO: 362 - DNA, 625 bp, Botryotinia fuckeliana
gatgatgttgtcaagtgaacagatgctttcaagggatttccctcccatattgatgccggaagaaagtcaaaagtctacaagactcgctgtggtaacatttctgaggtcattgaatgaatcgcaatcaaacatgaccatggccagcgaaatgctcgagtatgtccggcaagcctctggtccaagtctactggctgcctactggatctcatcccaattgatacaattggctgcttctcaaaacgaggaaatgaatgaatttttcgaatcgacactccttgcttctgacgactatcaagccacgaatcatgatctgtattcttactcgatatcagtgttgtctagcgaagaccacaacctggattggcgagtgaaaggaatcgcgctggagatcgtgtctaattcggctaagcatttgaaggaagactttcgagcagagctcgtggatatcctgtaccccgtgtcgcagcttctaggttcgaccagtggtgatttaagagggcgtgcaactgtctgtctcaacatacttgcacaagcttgcggatatccgagcacccgagaacttatcgtggagaacgttgattatatggtgaacgcaatttcgttgagattgaacacatttgacata

SEQ ID NO: 363 - DNA, 787 bp, Paracoccidioides brasiliensis
tggatccccggctgcaggtggtatcacagacatccactgactattgaaagttcttaggcgagcgcaagaagtaatgtataaaggggaaaggcactgctccagtgtctaggcttcgtaataatttgagataaccgtggaaagaggagatccaaaaaatctttccacttaggtgatgtcaagtcgcaggagacgttggcagcgatagggaggaggaaagcttcaagaatttggcaatatgcctgtttcagattctggccgtgtgaactcacgaataatctcgccacagcttgtagaaaatcacaggacctactccaagcatcctcggggaaggtccgtatctttagatgcctcattccaaatacaagcagctccgcttttgtctccaagtcccttgctgatgacagtcgcgagtcctccatttgacattggctcagttccgcaagaaatctatttgtaacgctggaaaaattggactcgctcatgattcccaagagttgaccgtaaacacgccaattcgccattcggaggggggatgctgcaattgggtccggatcaactgtcttcaattgtccgaaaactatgtcttctagtcgatcagccatttcggtcgtgatagcttgcaatgtactctggttgaaaatctcgatcaggacccgacacacgaggtaaactgaaactgtcgcacgacgttcagccagcagaatatcttcttgacgtgatacggatgacatatgtgaattgttcggtagagagttgggatcttgggtttcaggcccggcctgtgtaa

SEQ ID NO: 364 - DNA, 8850 bp, Ustilago maydis
atgcaggtcgtcattcccgacctggacgacaagcagctctttgcgcctccacgccgtatccagtctccgaccgcctcggtcgcgtcctctagcaaccatagcatcacaaccaatctaccagagccatccatttgggcggaccagccatcgtcgttctactcgcctacttcgtatactcataatccatattcgcagtcatccactcaatcacccatctacgcccatgctccttcagggcccttccgtggtgctgcactcggctggcatggcaggtcagggagtgccacaagcgattcgtctgctggaggattcggaggcctcggatttcgtgcgcctccttcagaagtagagcaacccagttcttcttccaatctgaatccggctactcgtggcggtacatcggccgctgcttcctctccgtcttccttcacctttcccaccaagcgtccctcactgtcgtcgcttcgttcacagatgcgtgcccatcagctcgagcccgaacctcttccgcagcaccattggccttctacgccccgcgccgaacttcctcaactcgaaatccctgcatctgcatcggatgctggcgacctcacagcgggctaccgctctggcctctcaacccctcgcccaccaccccctaccaatcttcaatttcagcaacacaatcttccctcgcccggcttccactcgccgcaagagcgatccgtcccgctgaactcggtacgaggccgcagcgacagctacacctcctcaccttctcgctacccgggccacactgcctccgcctctcgatcctcccgcttccatcacgctcccaccgcctctttccattccgattcacacaactccaccggaggcatgagcagttctgcaagcagcgcagcccacccttatgctggctctgtcaccgatctgccgcctgtacctccgctgcccaacaaggcggacagtatctatgccgatatgccggtcactcctggcggtcataccaacaatgctgctttccagctcccgcgcgctatggccagcaccacttcctttgagaactccgaccttaccggtagcccactcaaaattagcacgcgccaacttcgcgatgactccgctcagcctcgacccacacgtccatttgatgacaatgaagatgcatccagcggagaacatgctcaatggtcgagctctatccggccgcaacccaaactactgcagtcttctaacagacgcgatcaaagtcctgctaccgcgcgaccaactgcccttgccatcagtctcggcgcagaaggtctcggccagcttcctgcaggtatcggtacccctgatccaaaggctccggtcgagtacgcgcttaacattctcatgagtcggttcatcactctcgccgcagctaaggtgaaaagagcactggaatcttcccaagaccacgacccgcagctgctctgcgccctaactccagatgacgatgctctcttcgattccgtttgtgactctctcgcccacatctctcgcaaaggtgctgctttggtcgtccacagtctcttccgctggaagtccatcaccgtagaggccgacatcgacgctgacctcgttcgtcgccaccttgcttcagctgctcccgccacagtcgcctccatgagcgcgaccacacgcgatattgcgctttacctggctcgtcgaaaggagctctttgcctttttcctcgccacaaaagcgcttcatgtcattacaaaggtgctggcgcgtgattctctgggcgaagcacaagctgccgaactcgaagagcagaccttcgccatgctcctcgcttgcatccgcgacaaggacaaggatcgctcttttccgcgccccatcaaccacattcgcgacgcatgctttgagagtatatcgcatcttatcggtgaaatctcgcgcgtgcgcttcgtcaccattagcgatcgctttgtcgagatcctggagcaatccacaaaggcgccatccagcaagacggtcgaagatctgcttgttgctgccatccacactctccgccacttgaagatcaccacgtacccaatggagcttttcgaggaaggcgccgaatttgtcgacgttcttgcccgccactatgccaattgccacggtttccgtgtcaaaaccagttttaccaaagcttttgctcatcttatgctgcccgtcgcccagaccgcatcagccgaagtcaaccaccctacctggacaaaggccatcgatactatctggccacgtatggttgccatggccgccaagcctcgttactggacgtttgcctacccgctccacgtaacgctgctgacggtttcgcctgaagagaagcttgcttccagctggttcgcttgcgttgaagctggtgtacccaagctcaaggatcgtgtcaatcgcactgttgtcctcaacgctgccgtaagattgctctgggcctatgcctttcggtgccacgagagccacacaaacacacataagaagctcgaggccttcttccgactctggtttccagccaatcgccgtacgctcaatcctcccgacagttcacccgaccccttcattatgatggttcactatgcgctctaccgccatttcgactttggacgggagcttctgctcaactttctgtgccattctttgctcggcggaagcacactctcgctgcaatcggacgtccttactggccagcgtatgaccattgcgatccgagctatactattgacgctcgactcacatgtcaaaggcgaatcgcctccctttccgtctagcgctgactttcaccatttcgatttcgacaccctgcctgacggctgcggcgatgagcttccagaagcattcaagttccccaacgtggaaatcggggagacacagaatcagttcaatgacctcatctgcaaaatcgctctgctctgcgaccatcaaatcagtgacatgaccatcttcgatgcccgtacccatctttttgctcgtacctccccaaatgccgccgcttccaccgccgagcgggcactgctcgaacgcgaaggctacacctggcggtttcaccgtgctgccatgctcatggctgcttatccacgcgagaatcagccgtccagcgatcttcttcgcgcttgctttgaatcctggcccaggtgcctcagcgccaacatttccttctcaagcgtgctcgcagtcctcttccgtgcccatttcagcgccgatcctgacctcagcagagcatcggcacgtgctctgcgacgcatcactagtcagcgaccgggaggctcctcagccgtcgtctcgggcttcatgcgttgggtattccgtatggatacggccttttgggagattcaccccaagcagatgctcatcatgcccaagatcgaagaggctatccggctatggatcgactttttgcaaatctggcttgcacagcttcgcgtccagaacagtcaagctgatcagggccagtctgggctgcaaaaaggtttcgaaatggagcgcaccagcgcttgggcacttatggacgaagtcgaggcctacgcgctctttttgctatgttcggcttctcgctctctgcgctcattagcggtcgaagtgctgcggctgattgctgtcttggacgatgcctttttgtcgcccagtcgtcgcgctgcagttgagcaagcgcgtgctcaaggcgaggaagaggagccgactcgtatcgtgcacctccttgacatgccttgtcaagacttcctcgatgccaacgacccacatcttagctggcatcagatcaatcatctggcccgctacaagtcaccagaccgctccacctctctaagaatgattgcagagagcgaaagggatgttgagcagtcgttgtggtttcgagcacttcctctcttcttgcgcatgagcttggagcgctttccaacgacagttgccgtatttcgctcctacatcacagatcgtgttttggaaatggaccacgttgctgtctatgcagctgacatttccaatcgtgcgccagctcacaccatgtcgagcgccacgctcagcaagtcacaggcagcatcggcagcaactgcatcgctccacagttccagctcgatggcctcgttgagggacgctgcacctgctggaacggccggccacgctgaaactctgctgatggctcagcactggcgtttctacgtccttgccctatgcactacaactacctccacagagggttcacgtggaggcgtcgttggtaaccacagacgaaaatcaagcgaacctgagacaggtgaacgcatgatctcggcgcgcgacttgtttcagaagctggtgcccttcctcgcatcggacaacgaggtctttcaagaagctgttgtcttcgcacttggcaacatcaatgaaaatcactacttggcactccttgagacgatgcaagctttgagcgggaccctaaacgacgatttcaaggtgcggtcagtcgctcgtactggcctcaagcgaaatagacggctggacagactgcgcaccgctctggcacacgtgctccagctcacagctccgcatatggaagctctcgaccatctcgacaatgcaaaggtgattggtatcatccacaactgggtcaaggacactttcaacttcctcacagatcgcgagattcgtcaagactgggaatttcacagccttcggcgctacttttgtggggtgacccaacatctgtttgacggacttgccagaaggggctcggccgactcgcacttccccttcgaagtccgtttgcgcatgttccgcgtatttcgcgattggcactcgtacagcacggtcagcgaagacggacgcaacaagctggccaaccttctcagcacggctgccgaccagcagagggacgatcgcgccaaagagcgcgcggtcaagacgctcaattacgaaacacaggctctttcgtatcaagccggatgcgccatggcgtctctctgccagtgtgccatctcgatggtcggtggaccagtccctgcaccgatggcgggatcctcgcttgaccccggttcgctgctccactggctcagcagtcttttccagaccagcgacgagaagaaccacgacctggcacgcaaggccctgcgatcgctgctcgtctacaatgatcaaaatgctattcttgttgacagcacggtggaccgctgtattgctgagcctgatcgagccttgggcaagaagagtctctttgtaaccacagccgaggttgtgatcgagaaggatgacctgtccatgccgcttcacgccatcttttgcctaggtctagtcaaactcggtcatcctgactcaagtattcgtcgaaaagggctttccgttctggacgtttgtagccgccgcttcgacgagacttgtacgctggatgagtttgaagtgggtgtgtccagcccattgccagccatctatctgcgtgcccagcgagatgtcaatgtgcatctcgccatgcactttgacggcctcagaacggcgatgctcagcgagttcacacgtcgtctgcccttgattgacgcctcacgacgccctaccatcttgggactactgcccgaatggctgcgtggcctgattctacacaccgcagacgcaagtctcgacagctatcctgcggcgccgcctgaagtggtgctgtacagagcctacctgaacctctgcaatttgttctgcctcacggtccggtacggtgacgagcacaatttcgagatccaggagatctggagcagcttggtggccgcctcggaagatctgcagagtgctgacgcagtggtgtgcttccttatcaaccaaggccttcatttccgaagcgaacaggtcgtcacccattcgaagcgtgttgtatcatgcatatctcacacacaggcaggtcctcatatcttcgagcaactctgcgccatgatcgagccaagccgcatgattcaggtacctcgaaacgcttcggttccctcaccggatccggaccatcgtcatctcttccgcgctgatctgacaaagttgttgcctgagcccgagcctacgcttgccttttccgagggccagctggctctcttctatgtgggcgagatgacgtacgagcgtcgggaacagctcgagacgagccttcctactttgttgcacgccatctttatgcacattgacagccgctcggcatttgtgcgaacccaaatggtcgagctgttcgagcaattaatgcgctgtaccatctcgattggtgcaagtgccacgggcaatgctggcccttttagatcatcggtccagatatttgatccggaacgaacgacggctgccaaagcgcaagttgaacggctctttgcgaaacgaacatttgcaagttggacagccgagacgacagacgaagaacacgacactcagttcaagatgcctaagaacttgctcaacacgtcgtatgatacgctgtctttgatcgaacccttcttcctttccttccgccaggattggggctctgtggcactgacatgggccgcttctaacccgattcgacacatggcatgtagatcgttccaggtcttccgcgctctgcagccctcggtgacgccgagcatgatggtgaccatcctgggcagattggctgacactgtctctgaccataagtctgaagtgcatcgcttcacgttagaagtgctgtacgcacttaacttggtcgtcaagcaccgccagcctttcaatcgcgagtttctggcgcaaacctggtgggccacattagcatgcttgtcaactgtcaatgaagccgaatttgccgagtcggtttccattctggaaagcttggtcgacaggctggacattggttcacctgacgtgatcgcctacctggtgcaaaattgtccggaaggttgggagggagatatcggcgtgctgcgtattctcgtttcgcgtggtcttcgatcgtccgagacgtcggcgccgacgttcagactgatggcgaagctggccaaatgccgcgatccggcgctcattgactttgacgacaagtgccgtcttggctacctttttgttgccgccctgccatggttcttacaggtgacagaagaaagcctaacggcagctggtggattcgtgacgagcaagaacgatccccgcaacgcttcagcagctttgcgagtctccaaaaaggcaagtgctgacgcggcaggcgcgactagaatcggctcctcaagcatcatcactccggctcttacggcggttgaatcgcaaatggtcttggaaatggccgcagacttggccgctaccgcatcaaaactcgagatgcgtgaccttgaacgtgttgcgacgtccatttctcgatcgcgtttccgaaccaaggacgatcttgtccgacaagccaccaactgtatccgatcccactatctacccgagcacggccccgagctggccgtcttgctgctgggtgtagtgttgaaccggcacgaatggatgcgaatgcaggcgatgcaggtgctcaagatcttcttccaggcactcgacacgcgcaaccatgtggcattcagcaatctaggctcggagcttctgatgcccttgttgcgtcagctgtccacgccgctgtctgcacaagcgctcgaggtgctcgacgaaccgattgaggtgcacggtggtcccgccgctaatcagattttgcgcatgagtctgcagtggggcaacatgaatttcaacgggcagacgcgcgactttgttcatgacgcttccatctttggtccgccgcaagagagcggctgggctgttgctgatccgcaggacatggcgacacgtacgcggatcaacctgcaggctttggtgaaaatgtgtgaacacacgcttgacattattcccacaagcaacaatgtcaactttgtggtcgacgatgtctatgacggtactgcagaggccgacggtgctggattcgcattagatgaggctcctggcgtcggtggaacgagaactgatgagactccagcgtccagcttgggcgatatagtcaaccaactgcatgacttgtcttcgttctttggcgatgatccaatgtccaagagtcgccaggcatcggtaatgtggcgcgactcgcgtctcgaccgatccggctcaatgcggcaggcatctggactgggccgcgcttcgtcgattcggtccaatggactgagtgccggtggcactattgggcgcaatggatcgcttcgcggcggaatgcagtacagccgacaagtgtcgccgaatcctactgttgtcccagactcgctgcgagggctctacgcggacgagagcggtttcggcggcggcggtggtgggttgtaccggaccgcagtaattggagtgcggaacagtgacgaatcaaggtttggcggcatgtcgagaagcacatctggagctggagacgtatcaaatttttcgatgggccgttcggctagtacactatcgggtcggagtgaagaggcaggtgcgaatcgatcgcatgctcagatcgctaagatcttggcgcgctcaacgacgcgcgacagccgtacgtctgtatcccgaaccaatagcggtggtggccgaacaggatcgatgctagaagaacgcgctgagggtaaatccagcatggaatgcgatcgatcgaacagcgttgaccagctttccgaaacaagcggctcgcagcagcatcacggctcattctaccgcaagccctacacattcacgcagcagcatgtgtatcaacatcagaagcagaaaacttcatcgtcatcagcttcctcgctgtcgggctcacaatcggcagcgcatcaccgcggtcccgctgccaccgctgctactgtctccaagctgggcgttagtgccgatggtcgcttgcattcagttgccaaatctgccgcttccaatttgaagcactcggggggcgagtag

SEQ ID NO: 365 - DNA, 770 bp, Mycosphaerella graminicola
gcttatgagaagttcaagcgtgagatcaccgagcagcgccacgccgatttcgagaagcgacgcaaagctgccgagcgcgagctcaacgcgcagatggacaagcgccgcagggaggttcgcgagaggaagattgccgagaagcgtcgtctggaagaggaggagcgcacgaggcgcgaggaggaggagcgagcgaggatcgaagaagaggaggctgcgcgtgcagcagaggagaagaggatcaaggatgctgaagccaaggccgaggcggagaagcgccgacaagagcgtgcagagactgcgaggaagcaaatggagcgcgaggaggaggcagagaggagacgtctcgagcgcaaacagcagggtggtgccggtgccgctcctccgcgctctttcgagcgtccgtctgagcgtcccgttggcgacgcatcttctggtggcccaccacgcttgcagctcgcgggcaacaggccgacgtggcgcgaacgtgaggcagcaagagcccgcggagaagtcctcccaggagacaatgctgccgccccaccagctcccgcagccgaggagcgagctgctcctgaggaagctgcaccacgtcgatccggttatgttccaccagcactccgcggcaatgctcctggacccgactcgaccccgccagcacctgcggatgcgcctaccgcgcgaaggcagccacgagctcggggtgccgagcgcgatggcaatgatggtgcagcaccgccaacggagaactcaaccgcgcgatggcagcctcg

SEQ ID NO: 366 - DNA, 466 bp, Phytophthora infestans
tccgggtcgacccacgcgtccgaggcaacactgatcaacttgctgctgcgcaactacctgaaggacaagatgtacgaacaggcctataagttcgtgagcaagacgacgttccccgagtcagtgtcgaacaaccagtttgtgcgctatctgtattacgtgggcaagatccaggccgtgcagctcgagtacaccgagtcgtacacgaagctgatgcagtccatccgcaaggctccggctaacacggcgtttggcttccggcgcacggtgtacaagctcgcaattattgtgcagttgctcatgggtgaggtgcccgagcgtaatgtgttcaaccaggatgagctccgcaaggcgttggcgccgtacctgcaactcacaaacgtaggtttgctgaacgaggctgtacgcgtgggtaacctggaggactacaacgtggtgttatcgcaacacggagcggttttcaaggctg

SEQ ID NO: 367 - DNA, 563 bp, Mycosphaerella graminicola
accagattgcaactcatgacctcatacatgggcccgctcagcagcatcatgcgaagtctaggtgatggcggctggaaccaacccaacaatacggcggcgaatgcctcaatgcctaatctgaaatcattcgacgtaggtgcagatggcaagcagctcttcgcacactactgcatggacacgattgaagcactcctcaacacattggaactcaagggcaagcaaatgcagagacctcaaattgtgcaagcagccttcctcgccaacaacgtcgccatcattcaacgcatgatcgaatcatctgagctacgacctctactcgccggctctcagcccaagatcgacgcctggatgtccaaagcgcagcgcatgtgcggggacggatggaaagacgcgcagacaattctcttcgacgccatcaagacgtctcggcagaatcgtaccccatcgaccgggaatgccgtcgacaccacggcgattctgaaggggttgtcgaccaagggaaaaggacaccatcaaggaaaagtcaaaaactttcaacacatcgtttgacgaaatggtggcga

SEQ ID NO: 368 - DNA, 720 bp, Botryotinia fuckeliana
agaaagttcgtcaagttactcaagatcgagtaatcaaccgtggcgacaatcatcagactcttcaagcagcatcagatacaaagaaagtcgttggtatcatggaaagtttcattcaacgctttgagccagtaaatatatttgcaccgccagatgatggattcgactttgctatcgaactggatcctactaaggactcacgagaaaatcttgagactgttgttggacagctttctgcacaatttccgaagctttttaacgagttacccacgagtgaggatcttgatgatgcaattcggtttggattgagcgattacaaaccagatctcagacatgaagttggtcgtggaccagctaatagtcacaataagaatcagcagaaagagaacagaaatcaaccacagatcgcaaagaagaggaaaccattagaatatgtctccatcaacctcactcgaagcgacattaaggagacgcttgacgatgctttcggtcgtgtatcttcaaataaagcaaaattttacagatccctagagggaatgcgtcgagttcaaccagagtttcacgtcactcttatccaccgagctaactccaaacaattccctgagttatggcaaaaatacagtgatttacacgcgaatcaggttgctaaagatccatggagttccgaaactgcatttggtgattgtcaagttatgctggagagaatcgtatgggatgatcgta

SEQ ID NO: 369 - DNA, 3288 bp, Aspergillus fumigatus
atggaataccatggtgacggaaatgggtctggtcacccctctcagtctcaggagtccgcctatcctgacattgatgagacgttgcagtacccttggcaaggttctcagccagccgtcgcaggcgaatcctcacttcactccgtaattgatcctcgcctttacaaggatctgttttcgcggagcgcctctggccagcaagccatggagtatggggacgaggaggatgcacaggagtattcgcaactggatggctcggcggaggactccacttacgaattctcagcagaagaatcttcaacggaagaggagccttcagatgtagaagagaatgctgcagacgaaggtgatgatgattcggtcggtcggagacgacgccgcagaagaggcacggggcccttttctggacgatggggcgcccgtggcgggaaaggaatcaagagaggacctcgtaagccgctggagcccagtgcggaattcaagatgctgcactcggacgctacctcggcctttatcgatggcgactatgaaaccgccattgatcttgtgaagcgtgcaatccatatcaaccctgagatgtttgctgctcactcgctgctgtcggagatctttctagctcagggccagaaagacaaagctctaacggcgctgttcagcggggctcatacgcgaccgagggatgcatcggtgtggttcaaagtagcgcaaatgatacttgatcgagccggcgatgaccgtccagcagccctgaacgatgtcatctattgcctgagccgcgtcattgatattgaacccaagaactataatgcgaggtttcagagagctgctgtctatcgagagttgggccataatggccgggctgtcacggagtacgaaagaatcctcaaggaagttccgcatcatccacgggctttgcgaaatctggcagaagcctacattgatctcaacgaagttacgaaggctgtagatcagtggacggaaagtgttgagtactacaagtcctttgagccggaagatgctcccgacttttcctggtccgacgccaacatatacgccgaattgttcagctatctgggccgatatgaagaaggattaaaggctcttaagtctgtctcacgatggcttcttggtcgccgagatgatactatgtgggaaaatttcaacgaagacgaccgcgaatgggatgcaaacgattcgcctaggcgcatcaaagtcgatggttatattcctggacgttggccacgagattcatatgggttgggccttccgcttgaacttcggatcaagcttggtctgtttcgtctcaggatgggctacgatcacaaaaacgaagctctgcatcatttctcatggttgaacccagaagacacctcagaaggggctagactctatgattatggcgacctcttccgcgaggttgctgatgcgctcaaggaagttggtttactggaggacgcgctccggtattatacgccgatccagcagactactgagtatgccgacatcagctatttcatggccatgggagactgctttatgcagttgggcaacattgaagaagctgagaattgctaccttacggtggcagactatgatacaagaaacatagaatcgcgtgcacagctcgcaaagctgtacgagagcatcggaatgactgaacaagcgctgaagtacgtcaacgaagccgtgctgcttgggcgacaggagaccaaaactcatcgccgaagaaaggatactcggttggaacaactcgcgctcgagttcagaaccgagaccgatccggaactaccaggtctgagaattgctgtaccgcctgaacgtgctgaaggactggctccgacgcttaccactacttctgtaaacgctacgaggagaaaggtccaagaagcggaggaggaaaggacagaacttgtccagtttttgtatgggaagctgttagatattcacccaagggtcaaagagggcaatgccgaagcgattgaggactggctcgatatcgcggatgctttgctacgtgagtttcgctccaataaggtgttttatcctttccaacgcaacatcgtgttcctcggttattcaagggaagcacaaaggaaggcgggaaagtacaaaaatcgtactctcatggatgagatgcaggaaatggcgagtcgtctccaggagtctttaggcacagttaccgacgagtctctccaggacgctgtaccaaccgactaccatggtatcagcttcgacgagtggctggacttattcctgcaatacgcccttgtcgtctcagggcaaggggagcctgacgaagcgtacgatagtcttgcagctgctgcagatgccagtatttggtatcactcgaaaccttgcactcgacttatccacgtctgctggtttacatgtgccctgaaggcgcaagacgaggagactcttgcaaatgaagcacgctggttcatcaaagagtatcaattcgtcacagacacatatcgcttattctccatgctgagccggctctgcggcgaccctcaccggtctctcttccattcctcaccaaacatgaaattcatgctgcggcagatcaaggccatggacttttccattccggatggccccaatgactccagacccagcaaagcagtccgcgagtcaatctacagagagcgcgcgacgctcaccacccgcgacgagtcaggcgaagccattcccgctgatcaattggacgtcgccctgcttgtgctatatggccacatcctatattccggcaacagtttctacccagctctcaactactttttccgtgcatacgatctcgacgaccagaaccctgctgtcctactctccattgccctctgctacatccaccactcgctcaaacgccagtccgacaaccgtcactacctcatcatgcagggcctctcattcatgcacgaataccgtcgcgttcgcgagcgaaagggaagcctcctccaggaacggcaggagatggagtttaactttgctcgcgtatggcatctactcggcctcgcgcatctcgctatcgaaggataccagcgtgtcctggcgcttggggagcagatccagaccgaatctcagaataagatccctcagccgttgaccacgaacgcggatccagcagacagtagcgacgtcgtgaaagaggatacccatcacgctgggcaagttgggattcggtttgtggaggacttctcgcgcgaagctgccgttgcgctgcagaatatcttcgcattaagcggtgacctggagtcagcgagggaggttacgagcaaattcctggttatataa

SEQ ID NO: 370 - DNA, 336 bp, Fusarium sporotrichioides
tgcatggcttccgaaagttgcagtctgtcttgcgcgacagcaagggcatctttaccgatgataaatttgaagctcttctgattggtcttttccaatatcttgaggatcccctgagcggaaccagccctgagaaagctcaggatatcaaggctcagatccttgctacaataaggctcctcctgaaaaaggaacgcgacaattttcagcctcatgtttcaagaggccttgaatcgcttcttgagacccgcagtgcatatgacatccgcgctcacattgtcagtggcgttgaggtgcttgctgacgagcttgttactattggtgatgggtccgagattg

SEQ ID NO: 371 - DNA, 629 bp, Phytophthora infestans
  misc_feature (615)..(615): n is a, c, g, or t
gacctcttcgtgtacgtccccctcttcaccaggtgaaagccaccttagctcttcgctgctaacccccctctcctatcagctcctacacacacgttagactctagcatgtcgcacttcttccacaagccggaaaatgctctgaagcgcgcgcgtgagttgttggccatccccaacgtggacgccggggtgctcaagcgtaccaagcactcggcgctcgagatcctgcacgatgcgctcatcgccaaaaagaaccgcacgtggcagcccactcacgaggagctcatgatcctgtacctggacatttgtctagagctgcagatgggccgcgtagccaaggacggtcttcaccagtaccgcaacctgtgcatccagcacaacccggcgtcgctcgagaccatcattaaacacttcgtcacgcaggctgagcgcaagcttgcggcagccaagaaggagagcaacgagctcaatcttctggccgctgccaaggtggatctggacgctgcgcagacgcctgaggacgtgatgctgtccaccaccacttttgagggatccaacgaccgcactgaccgcgaagtggttgttccatggcttcgatttatgtgggagacgtaccgnacggtactggacac

SEQ ID NO: 372 - DNA, 336 bp, Fusarium sporotrichioides; identical to SEQ ID NO: 370

SEQ ID NO: 373 - DNA, 770 bp, Aspergillus flavus
ctggtcctggaaaagatgaacaatccaaaggcagctctaattcaatatgggcgagcctgttcattggcaccacattccgtccttgctaggttccgcaaggctcgcgcattaatgaagctgcaagagctcaaattggctctagcagaattgaagattcttaaagacatggccccagacgaagcaaacgtgcattatctcttgggtaagctttacaaaatgctgcatgacaaggccaatgctatcaagcatttcaccacggccttgaatttagatcccaaggcggcacaatacataaaggacgctatggaatcattagatgacgaagaggaggacgatgaagatatggcttgatttctacggccttcctttcccccgcccctgtcccaagctttcctaaacttccgcacatgtgactctttctttaccttcctcttatttgcttcggtttctcaacatttgctcttgagccacgttcctgcttggggttctaattcatgacggttggcgtttttccctatttttctcctttctgggtcaaatctgcgtgagcatcagcattacacaggcgttaacaggccggttgagtagagagtgtgtttcccagcatcaggctctcgaaaaggtgtcgaggctcttggttctgtacattagcgtgggttggctttctcgcgttttagctgcgaatgagacatgaagacaccaggcgacagattcgtggacatataccgtctgtcgtgcgaggcatttccataaatcattcatccttatgt

SEQ ID NO: 374 - DNA, 376 bp, Paracoccidioides brasiliensis
ggagctatggccggtatgcggaacatggtccatgcggaggagagtgcggaggtggaggttctgtacgcaaatctggagaagctcaacaccctaaccaagaaaatccaaggttccctggctcggcttgaaaccagtgggaaggtggtaaaagatgcgattgggccaatctacagtaacacgcaattgttgcaagtcacgaataccaacatcgataaaattaatgaagccattgatcgactccgtcaacccctagatgtcaaagaaaaggaggagtcaatcatccgcgcaggtcctcggagcgctgggttgtcgcagtatctgggtgctctaaaacgagtggatcgtgcactatcagatctaaactctaccaaccttc

SEQ ID NO: 375 - DNA, 3593 bp, Cryptococcus neoformans var.
atgctccactgcaacccattcgcgggcgctaacggcgccacacaggtcaagcccatatgcgtcgctctcatgggcatagcagcccagacacccacgccatattctgaacatcacaagctcatagataaactctacgctgctatatcgaccgtcccatctagcaccatggaccctgccgtcatcaactatgtcctcttccccatcaccaatatcatgcgccaatccaatcctgccagtctccccgataactttttagaagcagccttcaatctcctcgcgctcatggtcggggcttggaggaaatgtgatggagggatagatgtgatcgcttgggagcagctttggagatttagcgtcgcagcggttggaccgaaggttgtgaacagagaaaaggacaagggcaaggagaaagaagccggtcaagaggtccagctcaacgctgtcaaacttctggccgctcttcttgaaccctcaacagaaaattctcccactttgcacccatcagcagcaatgctcgagaaagtcgccaatccaaaatctccgttgctgccgactttgtttcaaacaatcactcttcttctcgagaccgtcctgccgtctccaccctatttacaactccaactctcatctctcagactgctcagacgcctgatgcagtcatacctgcccgggaaacatcaattccttgccgcccttttaccgggaacggtgagcgctatggcgaagttgataaataccgagggtaagaacctcaagggcgaggctgcccaggaaagtgcaggtttaattgagattgtggtcactttgactttgaacgaccatgaccttcaagaactcggggttctcagaccgcctgccgaagatctaagtcaattggccgaggagtgggaggccgcaaatatctctaccgacgagccaccccccccttcaccggcttctagcagcacctctattgctcccaatccctttccgcctctcactgcctcctatctatctttcactgccactcagctgttgtccgccatccccccagtgctattcaccttcgtacctcattcttcagatctcgcgcgcattgcggcttcatccttggcattttcactcattgaaaaatgctccaaatctctccctcttctccgacctcgtgcccttacatgccttttactcttatctcaagatactttcgaccctgtccgtcacgatgctcgtcgaaaacttagacgattgatttctacagagacgtccactctctcgccaatccttgtcgaccttcttaacgatgctgtcaactctctcccacgtctcgtgacatcccaacaagacaccaaggtagacgaaatcgctcgactagtaactgctattgcagaggcttctactgagctttcgcgaaatcgaaaacaaccagcaagaggcaatgcgatcgcggagctgttaggaccaaatgggaatgtggagagatggagttgggcattgctggattgtctcgagtttggaagaccttccggatggagtgcagctgcgggaacagcggaaagagctgcccggttggggtgggagggcggattcagtcaaaaaagcaacttgcttttaatggatgggacagcggaggagcaggtcgaggatgaagtagaggcgttgggcagtttccctcatttacccttgcgttatatcgagtctgaagcgacagctcgcaggatgggagagatgttatcggcattggggtcagcagctgaggaagcggctctttactcggtcgagtattttatcaggtttaccaaaaccaacagaagaaagcatactgtcaaagctgtttcgtctctgtgggtagcggatagattgttgtccggcgttatcatgtcacaacttgaaggagctgagggaaaggtcagcaaggctacgagaaaaatggctagggaggttgttaaagcggttattgttatggaagaagatggcgaagaggaagatgaagaggattttgggtacgatcaggaaggtacttcggcattaattcccattgaaaggaccaagggcatcgacaccctcaccactcttctcgatcgcaaccctctacccaattcccatactgccgcagaaacccggcgccttcatctccaggcccagcagacacttcttacctcactctcgctccaatcgctctccctatcagctcgcgtactatcatcctccttccgtcctctgcttctcaccacgctctacatcattctttctcatcttgcttcaccgcatcctatcgtacaatcgtacgcatctctcaccttatcccatgtcgctcaatacactgggtatgcctctccagcagctctcatccttgacaatgtagattatgtcatcaatgtcgtcacccaacgtctgacatacaagcgtctttcggctatggcccctctcgtgcttatcgctatgatccggcttgtcggagagccaattgtacctcttgttcacgacgtcgtagacgaaatctttgatgctttggatgactatcacggatacgaaacgatggcgagcagtttacttgcagtgcttgtgactcttatcgacgtgatgagcaagaaggtgaagttggaagcagaggaatcagaagagaaacgaaagaggaaagctgaggaacttagttggataggtaaggcacctaatccagctggtgactttgcagaatttgagaaatggtgggaggagaaggctcaaagaagtcagaaaatagtcagcgagatcctagagagagctccgcaacatgcatggggcagagaggaagcggtcaatgaagaccaggatgaaacgactggggagaacgataccaagatggatgaagttgaagtgcctgccactcgatctcaacaagtcgccacccgaatcctcacgaaggctctattttttctcacccaccgctcccctttccttcgatccaaggtcctctcccttatcgccaactcagtaccgattcttgccttggggaaccgggaatcagatctcctccctcttatccatgattcttggtcaagcatcctcaatcgacttgacgaccctgagccgtatgtcgtagttgaggctgcagaagtcattgccagtctttgcgagcatgttggggatttcatgagcaagagagtattggagcatgcctggccaaggttgctcaagctgttggatgagcagcgcgaattggataggcggtctgccctcgctaggcgcggcggaatggggactgaaagctcgtttacagtgtctcaccgtctacatattgccatcctcaagacagcaatttttatcgctcgagaagtaccggtagcagacaacgttttatgggagatgatgttgtctttcagagtctttattgatgatcgagtgcatgaagagctgtgtgggaaggcgatggagctttacacagagctgggaaagagggatggcgacgccttgtggattgtgctaaatgggactctggggaatggagttgctggggactcttgggagtaccttagtcgggcgaagttgaatattgagcgatgtgcatctattctgttgaatgccatctagaatgttgcatctcgtaagcatataatatatgtatcaacatgcatgat

SEQ ID NO: 376 - DNA, 707 bp, Aspergillus flavus
gcagatcggacggtcaaagtacaaggtccagatcgacgagatgcttagtctcaacgtcactatccgcaaccgatcctcaaggcctatccatcccattctccgactccagccaagccttcgtcaccaacccaacaatattgcccttgatttgtcaaagcgcctcgcatggaccggtatgttgcagcaagtgctacctgtgatacatagcggtgagagcacaactgctaccgtcggtgtaactatcctttgtcggggagagtacgagttcggcgcgtctgtggaggaattgcgcttcttgagaccttcgcctggtaccgaatcagatacccatccccaggctcaagctcaagcgtctttccacgacgacgacgacggacctatcaaggatacgtttggtgtagacgtagccaagaaaagacatatatggcatgctaaagaagcctgtgtcatgaatgctcatgggtaattgctgggatgaatagaatcgtatggcgatcttctatccagcaaacatgtattcttcaacgttagcaaccttggctgaggatttgccggttgggatgagatttagtggagatcgctatcgcgagttagcgagaagaagtgtcttaattgaactatagattatgtataaatatcaaattacatggtttacgagtggtctgcgaagacgggattgcaggctagttcatgcaattgtgtatatg

SEQ ID NO: 377 - DNA, 647 bp, Aspergillus flavus
atcacatcatgcctcgtgagaaccaaaaaagaggtcgccgagcggccgaaaaagctgagaaagacgccgcgaaacggaagcgcgaggaagtccccgaagattcactgccgaaacggttgaagccctcgacggacgagtcgaccgaaatcaatcaaggagctgactacatacctttcgacgagaattacaatgagaactacgatgggaactatgatgagaatcaagctgatgcgcctgcgggtgatatgcccttttatggtcttctcgatcccgaagaacaggaatatttctctcgagcgaacgaggttttggaattgaaccaattccaggatgcagaggagcggaggatattcatcgacagtgtctataaagaggccaatggggaaggagttgaaaatcgcttgcagtcagggatgctcacggctcatggaaaaattgatatcgatgtcggatatgcgccaaattcacaggctatttaacaaattcattggtcacttcatgaatcttgtgcagcatcggtttgctagccattgctgcgagaccctctttatcaatgctgcacccggcgtaacgcagaaagtctcgaaatcgaaaagcgataagatggatgtagacgaggaagaaggagaggagcccgagcctgaact

SEQ ID NO: 378 - DNA, 466 bp, Paracoccidioides brasiliensis
ccaacttgtattttcggaaaccgtgataaggcttgcacgtgttctcgcagccacttaccttcgtgacggttcacttgacgacaacgctctggggaatattgtaatgaacgaccccttacaatttctccgctctcccgaacgccctcgaggttccctttcacttagcaaaacggatatagcaagctttctattccgagctttacccccatctctaggttccgatcttcctgttaccgattcctccccaattttagttggcatggcgtccactctatggacgctggggttagaccggaaaaaggcgttcgtactaaaccaactgttttctgttctaattccagggttggtacaagctcggaaaattggcgctgcggaagttggtattcaccccgctgctggcttatcagctttgaactacgccgctttcgacataaatgcattggatgttgtgccgggagatatgaat

SEQ ID NO: 379 - DNA, 920 bp, Alternaria brassicicola
tggccgcccgggcaggtactggatcgactacttggcgagtcaagcaccgctgccatatgctgcacatggatacgcacaatactactgcctttctcctgctcgacaagcatcaccatcccgacatagactaccaacaaggcatgaagatattgcccatgtgcaccgcaccagcccccccgacgcccccccccccgcacctctcggcgcgcgcctcctctcgttccccaatgtaattcactaatccagcactgcccacaccccccacgatattattataaattcaacactaaaaccactcaccacattaattacttcctccacccccactcgctccggtaaccccacgccccacacacctcacacaccccgcccccccccccacccccccccccccccaccacaccccccccccccccttctccttcgttacaccaacacatcctgcccccaccccggttcactccccaccccgccgggccccccagtcaagcgccatccggccgacaacatacctccaaacttcctcccccccaactgctcgccgtaccaaacccacagcaactgtgatccccgccccacgccacatacgatctctcacgcaacattccaacccacctttacacatcatcccaactcccatctcataaaagacgagtacatttgatcaccgcccaccacccatcacgatctcatctctatacatatccacacaccgcctcaaaccgcccaccccaccaccactcctccccgcccatacataaccgaactcatccccgtcccccatacaagccacgacttgaataaaccacccctcgccacgaccaccgctttcctctgctccccgcgcgtcatgcgccccacaaccctctaaagtacgaaatttatagacacctcaaatagacaaaacccacacctacccc

SEQ ID NO: 380 - DNA, 760 bp, Paracoccidioides brasiliensis
agtcgtgaagctggagcccccccgcgggcctatagtggatccccggctgcaggaatcggtcacgaggagacgatgtaactcccggttgtttaatcagacgagcgggtttgatagtggattcaacgaaggatcagccctacgataaacccctttttgctgcgcaggatgccatcaatagcatttatcgtcctcgagctcagggagatgattttgatgatgaagaggcggcgggggcggagatgagtcggatcgagcgcaataaccgttttgaagtcctgggccgcgcaaagcagggcttcaagggcgcagcagatgcagaggctcgagatggacccgtccaattcgaaaaagataccacggatccatttgacatcgatgggatgattgctgaagttactggggcgggtgggcagaagcgctacggcattcaagaagctgaaggaacaaatgagcgtggatcgaaaccgtgcccgtgttaaacgatgacgatgaaccatgatcgaagggaatagaaattgagccttgtttatttaaggagggggagacactattttacctcctgggtgttctcttctcgcacacactcgcccgtttacgctctacgctccgcgtaagtcagtttaggcttgccttctgcatgtttttctactttgtacaggatctggtattcccctggcgtttattcactttcccttcccaatttcaattctcaactccattctggttctgtagcgcgatttggaatgttatttatgtccat

SEQ ID NO: 381 - DNA, 615 bp, Candida albicans
atgggtaaaactaaatctagagggagaagagctgagaagaagaataaaaagaatgagccaggatttaatgaagatgtatcaaatttagattcagatgtaactattacaaaccaagaaccattatcgtcatcaatgtcttcaacttctggtattcctaatacattttttgggcttgtggataacaatgagttagattattttaaacaagctgaatccacattaaacattaatgcatttgaaacagatgaggaaagacaaggatttataaattcagtattagaagaagctcaaggtaaagaattgaaattggtgactaatcaaatttgttctaaattaatggaaagattaattttatttgccaatcacaatcaattaaagaagattttcaaacaattccaaaaccattttgtttctttggcatttcataaatatgcatcccacgtattagagacattacttgtaagatcagcagctttgatcgaaaaggaattgactcaaacagacgaagaaaaacttgaagaagcagtagaagaagagaagaagaagaagcagaagaagaagaagcagaagaagacagtcttaataatgacgtaccaatggaggacttatttataa

SEQ ID NO: 382 - DNA, 610 bp, Aspergillus niger
tgagcatcagggagaccttttacaacacttgcgcacactatgtcgctggtatcatctcaacagagcccgttcatcagagtatgaagttccagagccagcaagtaatcaaagctgcaggccatgccctgattgaggccgtctgcgatgatgcgtatgctggccaggagacatgccgagtatctgcccttttgctcctcaatctattggctgctctggataggcaagcggatggattgttggccgattctatatcccagtccaactatttgagcctcttcttggacaccatcaggtcgctacctatcgaattgagaaacgcccaggccagtgatactcctttgctgttgtcctactaccagtcgctcttgtctcttcttcaggagctttgccagaccaagaatggtgcgacgtatgtcctgaaaactggcctgttccaggcagtgcgggactcgcagctattcgcagccgacccagatctcggcatcgatattgataacccggatgctcttcgaaagtactatgacctgcttgactcggtcctccgagtggttgtcgccgccgttttctcccgagggctgcacaacgagcagatgctggagcaaactcgagt

SEQ ID NO: 383 - DNA, 3189 bp, Candida albicans
atgatcaggagtgagagtgatcctgaggattctgtatcaaatggtgacatgcatgaagaagttgatatgagtcccgatgaagaaggtcagttttatgaaaatattgaagggctgaggaatataattgattatgatcacgaccgggacggtgcttatagaatcaatgatggcgaagtgtatgatggtagcaaagaaggagatgactctttgttggcgatctttaccgatgttgaggactttgaagaagatgaggaagacgaggaagataattttatggatgcaattagagaagcaaataattttaaagtcaagcggaagaagaacaataaaagtaacaataagaaaagtagtaagaaaaggccaatggctcgtgtcaaagccattaatgatccggaagttgctcagcttatttctcaagccaatgaagcttttgttaaacaggatctgcctgaggcagagcgcctcttcaatgaagtgatcaaaaaagaccctagaaatttcgcagcatacgagacactgggtgatatttaccagctacaaggaagaatgaatgattgctgtaattcatggtttttagcagcacacttgaatgcttctgattgggagttttggaaaattgtagctatcttatcttcagatcttggacacatcagacaggcaatttattgtttctcaagggtaatccacttaaacaaagaagaatgggaatgtatttataggagagctttgctttacaagcaaactggtcaaattgcaagagcgttggatggcttccagaagatgtacactaagagtccgtcagatgctaatattttgagagaacttgctattttatatgtagactataacaaggttgagaaagctattgagctctatcttgaaagttttgaaaagaatattaaaaggcgacaggcaataattagagcatcagaagcagtgtttgagtcttcagatgacgatgacgatgatgatccaaattctaaaaactcggatgaagaccaaggagatgaggacgattatgatatacaaaatccagaggaactgaatatgtatccaactgttgattttaaaaaaattaacaagaaatataattgcgtgttctttgagtggtcgagtttgaatattttagcagaactttgtctaaaaagcaatcagaaaaagcttgatagtatatcattgattaaacggtgtgctaggtggattcagcatagagagggtcagactttttgggatgatgtacacgatgactctgaatttgatgataggagagcaaagaatggtagatatgatgcattaccagaatcggagaagacaaagtcatactcaatgccaattgatattaggattcgtttaggtcttttgcacctacgaaatgagaatgtcatggaagctcttaatcactttcaatttctttatgacgagccgttttctgatgtatcagatttatactttgaagttgggctggcactgacgaagtcagagaagtataaagaggccattgacttttttactccattactgtcaattcctgagtggtgtacaatcgagttgtacgagccgctcactaaatgttataaagagatagaagactacgaaaaagctaaagagtatggtgataaagttctggaaatggatcccaagtcgatggacgcaaaattgaatgttgcagaaatcaattactatttgggtgacaaaactacctttcgccagttgctagttgatgttattgaagaaagaaaacgtcaggcagagtctatatatgatcaaggcccaactaaaaagccacgtatagaagaatttgtcagtgagacggaaccagaaccagagccagagcatgaatcagagcatgaacagagggtagataaggatacatcagaaaagccacttctggaagacagtaaatacagagtttttaatacaaagaaaaagagaacacctttggatgcagagcgtgaaaggcttgatcgtgaaaagaagatgagatcaaaagttataaagaaatatgaaaaggtacatgagtataaggaaggtatgttaatgggatcagatcaagacactaaaaaatggattgatattgtttcggaactaattgatatattttctagtgtcaaaaacttttttgctaaaagtagatcaaagaaatttgttggtattataaaaaggacgaaaaaatttaccacgcctattgattataaagtagaacaactttctaagttagtagagggagaatcatttgtcaatgatttaccagtactggaagaaagagtcatcttatcttctactactgagctgagaggtttaacatacgatcagtggtttgaattgtttatggaactttctcttgtaataacaaaacatcaaagcgtagaagatgggctcagtgttatcgatactgctcaggaagttaacgtattctttcaagatcctattcgtgccaagataatgagatttgtaaaactgggaattcttttggagaataaagacgaatcggaactgacagagtcattgcgtggtttattaaatcaatttcaatttaataggaaagtgttacaagttttcatgtattctttggcacatggtcaggatgcattgaacattttaagttcaacagtccagcaaaagttttttctaagacaattgaaagccttcgatagcataagatatgacactcatgttactggacaggcttcattaaccaacaaagaagttgaaaatccggagaggaggccatctccttatctgtattatatctatgctgtattgctgtatagtagcagaggtttcttatctgccttacagtatctgtcattcttggagaaagatatgcctgatgatccgatggttaatttaatgatggggctagcacatatgcacaggtcaatgcagaggttgactgctaatagacatttccaattaatgcacgggttgcgctacctgaagaaatactatagcataaggcaatctatgtataccagaattgaaagacaggaagcggactataacatgggtcgcgcttaccacatgattggtcttgtttcaaaagctatagaatactacaagaaggtgctggacagttacgaggacggtgctttgaagaagcatgcagcttataattcaatgttaatataccaggaaagtggtaacttggagctagcaaatagtataatggagaagtacttgtccgtgtaa

SEQ ID NO: 384 - DNA, 566 bp, Phytophthora sojae
tcccccctccctacacaaccatggacatctccgccgccctcctcaacacccagagccctgacctgacgctgcgcaagcaggccgaggagttcctgaacaatgcgctgcagcagcaaatgggccagttcatggtgacgctcgtgcaggcgctggcctcggaggagttcgccgtggtgggccgccaggccgccggcctgtacctcaagaacgtgctggacgccaaggacgacgccctgcagcagcagaagatcaacgcctggatggccatggacccggccctgcgcacgcagatcaaggacggctcgctcggcgtgctgcagtccaacgaccccgtggcccgccacacgagcgcgcagctcgtggccaagatcggcagcatcgagctgcccaacaaggagtggcccacgctgctcgagtccctgctgcagaacgtgacgggcggcagcgagggctgcatccacgccacgctcgagtgcctcggctacctctgcgacgagctggaggagaacgctatcgacgagcaggacacgaaccgcatcctcacggccatcgtggacggcatccgc

SEQ ID NO: 385 - DNA, 2160 bp, Candida glabrata
atgtttacatcaggcaaagtgctgccgacaaagatccaaccgccattgttgagaccaatggcctacagagtattatcgaagaaatatggactgagtataaaatctgatggactggctgcactgagtgattttattggatcgacttttggaatggattggaagagaaatccagacacgatcaaatttcttgaagtatttgcaactgtttggaagcaacaagagagaggcctctttgtcgacagtactggagtcaaagatgtcataaatgaactgaaagaaagagaaaaggcaactttgcaagaatcacaaaatatggcttcaattccaccgaagacgaaaacttataacaatggaggtggtaaaaccactacaatcgaccgatttttaactaaacgtccgtcaccatcggacaatgacgaaggtccattagatcaatccatcgatgatatacctgtatcacaagcgacacagattgatgaagaagaactgccgatggcccaggaaatatcagatcaaatcagcagcccagcaagagatcaaacaccagaggaagaattcgataacagaatcttaaactggagagactattttagaatcatcaatacaacagaccaaaagaagtttagctataacccagttaagagacaaatattttatcaaccaccaaaagatcaactaaaatcagtgctaaaaatcccaaatgcacaagcaaaaactgatctattcagaactaggtactttctaaccagagatagattacttcgaaatgaaagtttccaaagcagtcacgacacattcaatcccttatcctcaatgattcaattgaagaataacataaataacaataatcaagatgacactcctacgggcttatccataacccagataaagaacttgctaggtagggacggacagaattttttgattcttggagttttgaaaatgaatcccaaaggccaatggtctctagaagatgcatctggatctatagacattgatatttcccagacactaccatctccggggctgttctacatcccaggagcaattgtactagcagaaggtatatattacacggtaggccacacatttgcggttacctcgatgacattcccacctggtgagagaagagataagactttggatcatattggtaatttggatttattaggaattcatggcaccgaaaaatcttcctatataccaagattagacaacgagattaaaattagactacatcttcttgagcaagatttgacacatcaaaagtttgttttactcggtggtgacttattcttggacgatcaacacgtaatggatgggctgaaaaaggtatttaccaagcttgatcaagaagcaccaactgttatcgtacttttcgggtctttttcatcatttcctgttcatgctgcaatgtcaagtaaaaacattagttcaactacagaatacaagaataatttcgactctttggcagaaatgctttctcaattcgagaatattataaaccatactcatgttgttctgataccagggccacacgacccttgggtatcactttgttctctaggtgctaatggctcgttacctcaaagttcaataccgacacattttagtaaaagaatgaacaaaatttgcaagaatataacctgggcgtctaatccaacaaggatagcttatctttcacaagaaattgttttattcagagataatttcctagaactctgcaaaagacatcaaattttatttccagttgttgagagcaagcgggcagaagacctagccgaattagaagagcaaatggcaaataattctattgatgatacaactatacttgtcgaccgtataatatctgaaaaacaacaacttccggccaaagttttggagtcacgaaaggtagtaaaaaccctcctcgatcaaggccatttatctccatttgttgattcaattagaccaatatcatgggatatggatcatacattaacgttatacccaattccttcgacattgattttggctgatatgtcgtctgctgcatatgatttaacctacaatggttgcaaaactatcaatccaggtaagtttatacacaaaagacaggctcgttatattcaattccaaccatatttgaaatctgtttctcaagaggaagtctttttttaa

SEQ ID NO: 386 - DNA, 3825 bp, Candida albicans
atgtgggacaaatataattttatcactccagcaaaagttcgagtgttgttggttccaataaatgattgcactccgtccaatttccaacgatatttacatttaatccaaacaaatgtcggagaggtgcgattattggatatcagagagaacaacaaattgcattatttcaactctgtaacttccccgcaaggaagaatcttcccagagtttattaccagctccattgataacgaattgattttccttcatgattttgatccatttagaaaaacattcatagtgctaggggtgggaccatatgggcaagatccttcgacggcattagttgaattgaaaaagaaatataacactgccattgttcacaatgttatactatttgacaccccagaagacaaattgaatgaacaagtacccgaggtgtttttccacaatgggactactagtcatttgacagctctagaaacaatattttgcgatataagtgggaattttttagaaaaactagacgcatatgcttctgcatatgctaatattacattgaggtctcctgtttcgattactgatagccatgtactaacaaaaactatcaatcaagcacagaaaagattaagttcagggtctacttcattcaaggttacctttaacaactcaacgacaacatcaactacaacacctggtagtacattagagaaatccaagactcatttaaaacatctaggcagacaacgtaagttgatggggagcttttatctcttggcaggcaagtaccatgatgcatttcaaaattttatagagagtttgacaagtctaaaaaaatctgatgatttcttatggctagcaagcgcacttgagggggttgctgtcagtatagtgttaatgcaattcattggcacagcatatcaattacctaatcaaacaatgaacccagtgctacaggtatcaaagatacgaggaagtatagacacggcgacagttcggaaaacatctatcgattccaatgtttcttctcccaggaattcaattaacggctcaaatgggtttggttttaatgctttaacctcagcaatccctgactttaacaatttaccggtgcaagaacttttgaagattatcacttcgcgggttgtgtactattttagcatgagcacaaatgatattgaaaacatggttcctgatattgtttacgtggaaagcattttacgaagaattaagctattgattggcattcatttttccagtagtatggaagacatagtcaagggaacgattacacctacaccaaacggatcattcccgaaaattgaaatcatcgacgagattgacaaaatattcctgctacaaataactgatttgaatattgtggatcaatgtagaatatattctgccttggcaacaatgtatgctgatttaggattaatgcgaaagaatgcatttattttaagacttttaatatcagcaattttgcctcacttaagttctggagagcttccagcccagtcaattaaagaagtccttgagaatgtatttgtcttgtatgatatctgtgatgaacctgaatcattttctgaagcagcgaggttccatggacaaagcaactggacttccttgcaaatacagcttttgagattggctttgaaagtcgcagaaaatttgaatgaccaagagctattgttaaagttgtgcacattattattgactagatacacacattgtttgccaactgatgaccaaatcaaattgaagaataaggtggatctggctttgaaatcaaatggtggtctaagtattccatattgggatccttttcttgttcgcaaagtcaagtttgtaaattcaaaaccccgtggcaacttaattcctatgaaagagacattgaactccaataattcactgcaaccatttttcgatccatacactaaaaaggaatcagataaagcgtttgttccaacattggtcaaagatgatatttctcaattgaaagtcactttacaaaacccatttgcatttgaagttgagattcatgagataaccattgttagtgaaggtgcacaaatagaaacgatcaaaagtttaattcgacctttggaatcaataacatccaaaccttcttctactatgccgaatggaaatatagttaataataaattacgtggtcatcctggaaaaaaatcgtcttcaacaaccctggtagttcatcaaggtgtatcgcacacgacgtctaccaattctgccagtacgtttgttcttgctccaaggtcaatggaaagtgttatgctttccttcaaagcaatttcgacaggacaggttaaaattactgggtttgatgtatctattggaaattgtcaaactcaattcttccatataatagacgaagagaagtttgatcatacaataaaattacaaaaagtgaatcaaaagtcaaaacaaactacatcagtgctagacaaagttgtgactaaccttcaatcgcagtccgttttgggtagggttatgacgagcctgttgagcttatccattattccaccacaaccgtctttgactttattagaaattctggcatcaaatggctgtttaatgttgcttgaaggagaaaaacataatgtaaccgttacattagctaaccactccgctcagtctattaattacttgactttttcattctgggactcaaacatcgagtttctcaacaagaaacttacgaacccaaatctaactgcagctgaggttcacgaattggaatggaagttacttgtattcaagccttttagaattttgaataaagacgttataggagaaacgataaacccaggtggggtagtcgaactccaatgtgagcttacaagcaggaagtttatgaatgaactgaagataatattggaatatgcccacaaatctgacaccgagcaaagcttcatgaagaatttgaacattcccttaaatgtgtcggtaatgccatcaatagatgttgttggctgtgaaatgttgcctgccataagcatactggataatgtgccccatagtattggacaagcattaaagtgcgttaagaatgtggatgactattgtttacttgtacttgatttgagaaactcatggggggagagattggaatgtaatttgaaatataatgagtttgaattgtctgaaccaatgcaggctgggaaaacacagagatttataataccaatcaagagaatcgaggtagacatcaccaagactataccttcgttacgtaacaaacaatttatcaaaaactataacatatcggacgaagaggagaagcatatgaagaaattgttttggcttaggaattccattttggaaaacttagtggggtcttggaaattgggcaggcgtcatggagtaattgatttacgtccaatcaggttgaccacaaaaatggcaaatatcttgtcctatgaaaacatccaggttcacaacactgtgcttacagatgatgatttgcaagtggattccattggaaaatcttataatttatcaactgaccaattttacgtgctcaaaacgactataatcaaccattcaaaaaagccaattaatggaatagtgcgtcaattaccatttccaatacataatactcctacaaagagtagtagtctgcgtcctcaactttctatcgataagaaaatgctcgtcaacggtactttacagaataaatttccagaaattgcacctggagatcaactagtattagaaaccagttttgtcattattcaaaacggtgagtttgaatggggtacagtagtagatttgttcagtgataaaataatttgtagagaacaactttacattacagcaaattaa

SEQ ID NO: 387 - DNA, 1899 bp, Ustilago maydis
atggcaaacacaccagtggttccaccgccagaactgcgcagaaccatcctgcgcgtgtttaccaccaagcactcgctacagctccattcatcagccatcgccttcatcacttcgacgctcgcggatcatggactgctgcaacagccactagagtgggaggaggcaatcgaagcgcttgcacagggtatcgttgatggccaaaccaatgctgattccaatgctggatctcactccaaagcgctagcttccactggcaaggatggtcctgatgaccaagagggttcgtccgatctggtaacagcagcagcgctggaaacggtctactcgaggctggttgtagctgattctgccgcgcatgcgactcaggctgcagtgcgagatacagcaaatggcgtccatcgacacgcacacgagttgacggacggagaacttccagatccacatcggtactttggtgtacattcggcctttacccagcccaaactcacttttgatccgatccgtaaagtgtttgagccaacaaccctttccgcgacgcttctgcctactgcatcgacacgatcgacgttcgcgcgtcagcgttaccatatcctcaaaggcgtgattttgagaaacgaaaacttttgccctccgctcgccatcgccaccgcatcatcatctaaaaacctcgccgatgggttcatgaagctcacctcgacaaagaacttgctcggacgacaaggacaacgatttttgctcttcggaatgctcagcacttcatctgatggacggtatgaactcgaagatgctgatggaactgtcggcttggatctgcacgacgcgattccgggcgaaggcattttcaccgaaggaagcttgatcctcgtcgaaggcgagtacacagtggaagagcgtatccacgtgtttgctcttggtcacccgccgagcgaaacgcgtgcacaggcgagatcgatgcacgcacatacggatttcttgggaccaccgcagactccgattcttgagccagccggcgcaccgagccgtgtagctgcaagagctccctggagaggcgcgatctcggtcaaggaagaggcggcatttcaagttcacgaagcaaatcactcggatctgtgctttgtgatcttttcagatctgcatctggatcatcccaagaccatggcggcgttcgctacagttcttcaggggtacgtggatgcggattttatcccattcgctttgatgctgtgtggcaactttgcaagtcaacagtattcgtcagccgatacggtggataggtacaaagctggatttgcatcgctcgctgaaacgctctccagattcccagccatagttcgcagcagccatatcattctagttccaggaccgcaagatccgttcgcgtcatcgctcgttccacgtcctccgctgcctcagggtttggtcgagccgttggtgtcaaaactaaaaacgatgcatgcgacgatccatttggcgtcgaatccgtgtcggatttcctatttttcacaacagattgtggtgtatcgcgacgatatgatgaccaggatgctgaggaacacggtgcgcatcaaagaccaagcgcaagaacaggagcgcgagcagagggaaagggaagagagggatttgaaaaagtttttggtctcgaccgttttggaccaggcgcatctggtgccgttggcgcagaggatccgcccggtgctgtgggatcacgaccatgctttgagcctatatcccatgcccactgcgttggtactggcagacgcatacgatcggtacgagttgacttacgaagggtgtcacgtggtcaatccgggctctttccgttccggcaatgctttcacttggtcgacttactatcctgccacacgccgaaccgagccaagcgagctgccactcgtctga

SEQ ID NO: 388 - DNA, 861 bp, Candida albicans
atggcatcttgtaatcttctagtcatacaaaccacatccataattatgtttagttcactactatcaaggccagtcaatagttcctacgatccgtcttatcatttttctcctgttactagagagattaaaaatgaccccacatcaaatggagttgtctcaaccacaaagaatgcaacacctcttgccccatcaaaatatgatacaactatccctttaaaaaaacgatatcctaatctagtacataatttccccaaaccagaattagatgagaatgtaatactagagactaaaaaaatcattgattccatattgaatccctctgatgagccaactaatgatattaattatatcaaatatgaaaatccaaatccaaatccaaatccaaatccaaatccaaatcaagaacaacaacaacaactgctgctgctgctgctgaaaataattcaaatcaaacaatttcaagaagatccaatgcttccaccaaaattcaaattacgtaagaatcgacatgaaaggatcattgaagatgttacatttgttaaagatctcaaaacgaaaaaattaactaaagaagatcgagaattttggaatataccagcagcagtatcaaattggaaaaattctcaaggttttactattggattagataaaagaatgattgggagagaacatgtacctatagaaatgaatattgaaaaatttaatgatttatcaacagcattatctgatgctgatttacaagctagagaagatcttaaacaacggaatgaaattcgtcaacagaaacaattacaagaaaaaagattacgtgatgaaaaaattaaagaaattgctaatcgttctaaaagaagacgatattaa

SEQ ID NO: 389 - DNA, 1278 bp, Candida albicans
atgacttctataccgtctgatataaaactaccgccatctgatgtcaaacaaacaattgataaaacagtaggctatgttattaaaaatggaaaatcttttgaagaacgattattgaaaaataataaaaatgataaattcacttttattaaaccagataatgaatattttccttattataaatggaaattagatacgtcaaagaaaaatcaagggctgactgaaacgtcaactgaaaatcaacaccaagaagaggatataataatagcaaaaccaccagatttaccctttttaatagatttacccattatttcacaacacgatttagatgttattaagataacagcgttatacattgctcaaaatggtgaatcaaaaatcccaaaattattacaacatgaaactaaattgaataatcgagctcaatttgagtttttaaatgaatctcattctttacatgatttatttcaaaaatatattcaacaatataaaatcgtgattgaattgtatcaaaactctcatggcgaaaacgtagaccaagaccaagaatatcttcaattgcgacaattaataaagaaaccacgaggagaatatgatatcttaacccaagcatataatcgggcccaatatataaagcaaaataaagtgattgccaagagagaacaagaagagtccaaagctcgacaattacattatgcactgattgattggcaagatttttcaatagttgctaaagttgattttaatgctattgatgcggttaaagaattgagtatgccgttaaaacgagatgatttgataaaacgatcattggatgccagaagtaaagatattgaattaccaaaagtagcagtggcggcgacaacaacatcaccagtacaagttgaagtaattgataccaagaaccaaggtctgacccaagatcagactgataataatacatctactccatctgcaccaccaatcaagggaatgaaaattaaagctgctggaacttcacgattgaaaaaatcactggaagcaaacacttcaatgacgacgacaaatacgattaaatgccctattacaggtaaactaattccagaaaatgaatttgatacacatataaaaaccttgttacgtgatccaagatataaaaaagaacaagaaaattatatacggaagaatttcagttatgcgtccaatattacaactgatcaagtatatgaaaatattaaacgatttgtgaagaaaagagctaatgttgaagatgaaaacccaaaaaagaaaaagaaagcttag

SEQ ID NO: 390 - DNA, 957 bp, Paracoccidioides brasiliensis
  misc_feature (45)..(45): n is a, c, g, or t
tgatccccggctgcagcgaatcggctactgaggctgcaacaccangttcaaaaaagcggaagcaagggaagaaggaggacgttggtaccgaccatattagctatctgtactctaagttattagagcttggaccagagatgagggagggccaagaagacgcaacagaagattggctggatatcgcagatgctctattgagagattttcgatcaaatcggatctttttcccaatgcaacggcttatgatgttcctgggatactccagagaagcgcaacgaaaagctggacgactgaaatcgactacaataatggacgaagtggaagaaatggcagggcgacttcaagcatcgctaggtactccagagattgaccctgccacgataccaaatgactaccactcgatatcattcaaacagtggttagacatatttttggaatatgctctcgtcctggcagggcagggccaaacggaagaagcctacgataccctttctgcggctggtgatgccagcgtctggtatcattccaaaccaagtaaatttcagatttatacctgctggttcacctgcgctctccgactcaaggatgaagagacgctctccaacatttcccgctggtccatgaaagagtatcaatttgtgaaccgacacataccgtctcttcgcagctctaagtcgactttgttggtgatccacgtaaatccctgttccactcgtctcctagcatgaaaacatgctagccaaataaaagcatcgagtacccttccgatgatcgtgcggccatgcggccgcgaatcagcttcgcttcagaagcgcacctgagacaggtgctcggcaccttctgcgggctggtgtcctctatcccatgcaatttagcgggaattaaaatcctatattccgctagccgcaaaacaggtccattgggcgtatccattaagagttataatttagggggtaa

SEQ ID NO: 391 - DNA, 3911 bp, Cryptococcus neoformans var.
atgcctaaaacactaacggaatccgaagtagaggctactttcgcgaagcttaaagcagcagaccccgacaggaaagtcgatatcatacagttctttgggttgcagcttgaagatgtagaagagcttccagcgagtgttattgaccccttcctcctcattttacctcctctcatccgttcacctcactcccttctgctatcctccgttctctcttccttcctcccatactttctccctctcattcctaagcaccccacgacccatttacgcctagccctccttcaagtccttccagcgctactagaaaaactcaatgacgcaaaagagagaatacactcggcagcgggcaatgcgatcgttattctgggggaactgagttgggaagccgaaccgcctataccagcctcaaacctcaattcaagtggtagtctaaaggctggaagtctatcatcaagtacggccactaaatcaaaaccgcacgaaacacttcctcatttatgggaaagacacctaaaagatgtgcttcaaggcaaagcttggcggtcgaaagtggagggtatgaaggtgttaacaaagatgagaagtaaagaaggtgctaaaatggggcttaaggcatggctaggggttctagtcgatctattggaggacggagatgggaatgttagggaccaagccagggagaccgtcgttgagctcttatcgcctccctcgaccccacccgctgctcgatcggaattcaaaaggctgctagtcgcgagaaacgtacgaaagaccatagcagatgatatcatcacacgtattcttagtggtgaagggtctgaccgctctacgcctgccgttatgaattctgaattgggtaaggaggaaggtgctagtaggtcaggagcggctgctcctgctcattcacaagcagatgatgtagatatcgtctatgtcgcctctccacaagacctcgagagagagttccactctatgttgcctttctttgagggtaaagagactgaagaaaactgggcaccaagggagagaagtatcgtactaagtctgagaacaacagtggcacaacaaagctgttaccttctcaaagagcttccagaaggcttaggggcggcgtttgacaactttgtcgaattccttttacctatactagggaagatgtctggctttaccaaaaagctcatcgctgatcgctcccaaaccgccgtaacatctattatcactcacactaccgttcatccccgtattttcatcaatcacatttcttccggtatccaagaaaaaaatgtccagattcgtgcctactcagtcaaccatctcaaaacatttctcattgtccatgcttcacatgccaagcaccaaatcgaagcgacgccaggtctgagtgatacgctggatgctgcattcaggaaagcattggcagacgtaaacccgggtgtgagagaagtgacaagacaagcattctggaggtatcatgaagtgtggagaagcaaagcagaagtcttgatgaacagtttggatgggcaggcgaggaagcagctcgagaaagctaatccgaggacggcggcttcccctatgccttcatacgcttcttcatcatctaccggtgctccaagctctgcaaatacaaagcccccatctaaaaagatggacctcaaggcgatgcttgcagaaaggaggcgagccgtgaaagaagctggcaaacaagcacaagagacgaatgcaggatctcctagagtggtgtcgaacccagtgtttgcttcaccgggagttcaacacgcttccatcacgggtctaccaagatcgagctctgctgtcgggattgcaagacatgtcgaaacctccagccctagccccgtccgttcacccacacctagttcatcggctactcgcattagaccttcaccctctcccgaacgtattcaatcccctatccagacgaagatcgagatcgactcgcccctgcgttcgcgatatacaagccttacgccagatttggcaagaagcccccccaaatcaccatctccatctttaagtccgagtctgggattgggcgaatccccgttgagacaggtcttgacttatccagcagctaatgggcgtcactcagttggggaaggaaaaagagcgatacccgagcttgtagaggtggctgacaatggtgctgaacatgaagttgacgagcttacgctgaaggaaggacaaaaaactagagatgatggtaatacggaccaggaacttcctccgacggtgcaggaagaagtggaccaggttgaacagagccaacaattcgaatccgagcctcggttagagcaccccgaacctcaacagggtaataccttctctacctcaacttccggtcgtgtgccatcgacccccgcacgatcgatagcaacaggtacaaccgcatctttacctaattcgcgtaatggaaacatcaaaggcgaaaagataatcagctcgaggctcaatcctgaggcattccaaacgccgctcaaccccaagactagtgctcttagaagcagcagtgctattcgtactccagcatggaaggactctccaagaccagaagcggtgactcctcagatgatgcagaagctgaaggagagacgacatgagaggagttggtgggtgaaaaggcaagagttgttggaaaaggcttcgcctctcaaacctcttaccccgtcaccttcatttgcgatattgcctgatatagaagccctggaattgggcgcaccgacgctcaagaatctccagaaaatcgcactcttctgcagctcgcatcctgtccgtcctgaaccaactgccgaacaggatgaagaggaaaaaagagcgtttgaagaggagaagagagtctggacagggctgtttgatagggtcatgaatggcgtagtagacttcttaagaccagacaaggacaaagaacttctcgagcaaggactggttgtcctttgggaaatcgttcaacaccaatggccattggtcgatgatacgcagagactgtgccacgggttgttcagattgagggaaagttctgatgccgttgtactcgagtcgactaacgctctgatatccctcctcgtccaaatctctgacccgatgcttctcctttgcaatctccgttcatctctcgatcgtttccttactaaacaccctgccccgccctcaagctctgcggacaattccgatccaatgaccagtgccctctcacaactgtcactctcgagctccaaagaatcgcctgagaagaggacgaggaattcgggctatctattcgggcttacaagtattggtatgtgcgtattgagattatcggcgcccgtgattgtttccgaaggcccaaaactaggtcagattgtcatggaagcaataaacgatccatcatccatcatccgccaggctgcccactctcttctactggccattcaatgcgttactcatgattccagaaaaacacttgcctttgtgcctgctatgtcacagggtcagaaagatctcgcggtatattatatggcacaaaacggggtcttggagcagattggacttcataaaaaagcaactagtgaaggagaaaaaggcagggaaggcgacagggataatatgactggcgagttggcagggttgatgtcgagaggggtgataagggagtgagtgaaggggaacctgtcagaatcattgtatagcatatctccccaaagaaatttgagggtaatcgatttactatttttttacctatataatcagaaatgccttgccaggctctcgaatttccgtcagattccgatgacgaccatgctggatctcgattacactatcgtgcgttgcaccgaacatgatgcttcccccttggcctaatcatatcgtctgttagagactacttaggactcaatggtctgcctgataatacatgactc

SEQ ID NO: 392 - DNA, 3855 bp, Ustilago maydis
atgagtgcagaggcaggtccgagtcgggtacctgcccgcaggtctggccgcaatgcttccaccaagaacaccaattttgactggtcacgtctcaccgacatggacgtggatggagacaacgaagaggccgaattcggtgcgctagccttaggcacatacggttacagcgatgaagactctgatttcagccaggatagccaggatgagtggtatgatgacgttgattccgactccagcatcacaacttctggcaaggtgccttcgaaaaagacatcgaagccagccactagaggaatccagacaaccaaaagtaaagtctcaaaatcgagttcaagtcgtccaaaaagtgatgccgctacgagtgacgactccaatgatgagctcgatctcgaatatgcatattccggggcaggggatggcatgggcttcgacgggccaaaatctcaattgtttgacggcgctagctcgacaagggcaagccaacatgaagacgagcaggacaacgccgattctgacttcgaaccaaaatcattccagcgcctcgtcagctcgcttcaagacacgtctcgtgaggcaggtgcactgcgtcagcgatgggacacctctatagaagctgagaatgccgaattcgaaaacgagcttcgcgcggctgctggtttcaagcagaagcgtggcacacgcagaaaagcccgcgaacagcccctttctccagaagtgcaagcattgctagcggacgccaatcttgcttatgtcgagcaacgcctgtacgatgccattcccaagctcgaagaggttatccgtatcgagcccaacgtcaaagctgcgtggaacactctgggtctcatctacgaagaagtaggcgaagaggaaaagagcatccagtgtcgtatcatcggtgcccatctgcagtcaggcgcatccgaagaatggaagtcgctcgcgtatcgctcgattgcccaaatgttgtaccgacaagccatttattgtttccagcaagccatcaggattgacaagaccgacatcgacagcatctgggatcgtgccttgctcttacgcgacttgggtgactacaaagctgcaatcaatggtatgttcgacatcctcaagcttcagccgtacgatgcatctgtggtccgagagctcattcctatcctcgtcagtacgagggactacgatcgcggaatcgagattctcgagcgatggagaaagtccagcatggacgcatttcccacgccgaacattgacggctacttggatccggcagtagatgggatcgagggagctgatgaatcgcctcaggccacgaccgcagctccggctgtcaacaggttcaaggtctctgagctggtcaccctcgccgatctgttgcttttgacacgcaagcctgttgaaaccgtcgccttactgcgacagacagcacgatggctcgatggtcgagcaaaggaagacttttgggatgctgtcaacgatgaccgtgaattcgacggagatattgatccgcaaattcgcaagcagcgcgatcaagacagatatggccgtcaagtcgagactgccgaacctcataagcttgatcctgaagttcgtctgcgcctcggcaaagcacgaatgatgctcggagatgtggccgaggccaaacagcacttcgacattctcactgacggcgatccgggtgatatcccccaaatctttgctgaagtgggcgactgctactacgagcacaagctctgggccgaggctctcgatattttcaccgaccttgctagcaccgagtatgctacggatgacgtctcactctatgctaaactggctgcttgcaatcatgcgctaggggagctcgaagaggctgcacggctctacgaacctgttgttgaagcagctccagacacgctagagtggcagatgaggcttgccgaagtgtacgaaggtttgggtgagaaggagaaatctctcgaggtgcttcaacaagttatgcagatcctgctgacgcagagggaggctgattcccagactggcatagatcaaggctcgagggcgacagcgtctccagtaggtgccactgccgataatcagttctcgttcttcgacgagatgggtacttccacaacgaaaaagacggctccctctgccaagcgggcaagaatgaattacgatcgtcaacaaagactcaaattggaggtacagcgagagcaggagacccagctatcatggagacgtcttgaattgctcgacccacacgtcttcatcgaaggcttctggaggcatgatgtagccgtttgtaaggaagccgaggaagctttcggcgacttttatcgttccactgaaagtatcgaagagcgtgaaaagcggtatcgacaaacagcacagtggctcgaggaagcaggtggtctcatcgacgcttttcgcctcaatcctcgccttaacggtcatcatctcaaaaagaagcgtcccggtggcagtcgcacctctgccggtaagcaacgtcgagcggaagctccatctaaacccaacaccctcgccagtctgctcaatcgacccgggggtggacgtcacgccatctccactcaagcgcgaaatttgctccaccgcctgcaggatcagctggtcgaagatgatgccatatctgacctagctgacggcgttgagggtggagaaaacggcgacaggggccgtccacgcaccgaaccgggcccgcgtcagctcgacatgtccaagttccatggcctgcccattgagcactggattgcgcttttcgcaaagtattgtttcctgctgatcaaatccaacgaacccatctcggtcgtcaattctctcctgcaatctctacagacatcggcagtagtttggggaatgtttgaccggatgctggttgttcaactttcgtggctctcgtgcgcgttgtacgcaagggactggccaacagtgtggagcggcgtgcgatggctcgcgcaggaaatgcagtttcacgactttccgctcaagttgggtgccagtctcaccaatgctactgggattcatagtctgggcagcatgatcggaaacaacgatgtcaagttctatcagaggaggatgaggcaggccgaggcggtggctcgcggggcaccatgtaagttttcggcggtgggcaggaggtggcatgtgccaaaagatgtgaccagctcgttggcgaggcgagctgacgaaacctgggataggcatgcaggagaagcaaacaggcatgtagctgaacaggaggacgaagcagaaggtgttgaagcgagcgactcggaaggtggatcgtcattcgacgaccaggacgaaaacgaaaaatctagcaatatcgacatcaaaggcgatcgaccggatgcagcactcgccacccgacttgcacgtccaaccaaaccctcgcctctagcagaaatgttctacggctacatgctactctactctggcggcttccaatcttcgtcagcattcttcagtcgagcttacgtgatccaaccgaccgaccctctactatgcctcgtcacggccgtcgccatgttgagcagaagcacaaaccgtcaaaccgacaaccgtcaccatatgatcctcactgccatgacgtttttccagcagtatgtcaagtttcgagcggacaacggagcgcgctcagagaatcgggcagagatcgagtacaatcggggtagagcaatgcatcatgtaggtctggtgcatttggctgagcaacattacaggaatgttttggagtacgacggtcaacaagaaggcggatgggggatgaaaagggaagctgcttggaatttggcgttaatctacacaacaagtggcagctcgaatctcgtaaaagagttgtacgagaagtatctttgcgtttag

SEQ ID NO: 393 - DNA, 563 bp, Phytophthora infestans
  misc_feature (10)..(10): n is a, c, g, or t
ctgaggacgntgtacgcctgcaggtaccggtccggaattcccgggtcgacccacgcgtccgtggtcctttagtgactccgcgtgtgaatcccctctgcatctctctcttcttccccacatctagacccccatggacatctcagccgccctcctcaacactcagagccccgaccttcagctacggaagcaggcggaggagttcctgaacaatgcgctgcagcaacagatgggccagttcatggtgaccctcgtgcaggctctggcctcagaggagttcgccgtggtgggccgccaagccgccggtctatacctcaagaacgtgctggacgctaaggacgacgctctacagcagcagaagatcaatgcctggatggccatggacacggccctccgcactcagatcaaggatggctctctcggtgtgctgcagtccaacgaccctgtggctcgccacacgagcgcccagctggtggccaagatcggcagcatcgagctgccacagaaggagtggcccgaccctgctagagtctctactacaaaacgtgacgagcgggagtgaaggt

SEQ ID NO: 394 - DNA, 615 bp, Alternaria brassicicola
gatacgcgggattaagcagtggtatcaacgcagagtacgtggggaccattatttccgacttccctacagcagaaggagggaatgctgtacggcaagccggccgtacaaagttcgaggtgccgatagatgacttcctcacgatgaagacttccgtccgtaaccgaagtccgcgtcccatctcgcctgtactaagactacagcctcacattgctggccttcctcacagcattgcctagcctttttttcgtttctcgtggacaggagtgctacagcgcaagctaccagtcatacagcccggagagactgtagaatctgaacttggtatcgttgcgctctgccgcggtacatatgaaataggtgcgacggtcgacgaagcagagttcatcgagaggggtggaggcgaagatgaaaaatcgaacgtcgacaccctaactttgctgcagggtggaaacgttttgggcgaaccgaagctacaaacttggcacatgagagaaccttgtacgatctttgcgaaatgagatatggagatgaatgaactagttggatggcggaaacacacaccccccccccaccccacccgccctctgcgttgataccactgcttaatcactagtg

SEQ ID NO: 395 - DNA, 3062 bp, Cryptococcus neoformans var.
aacaaaatgctcaagttgaacgaattgacatactacctcaattaccggagggcaatatgagtgccgacttcgctatagacccagcactactggacgaaaatgttaccggagtgtctagtcctctgcaagaccttggtacatctgacagtgatgacctgtatggagattcagacaacgaatatcaggactcacaaccggatgaggttggagaaccggacagtgatgttgtttttggacgactggcaggattagcgtcaaaaactgcgtctggcaaggggaagatcaacaatgcagagtttcaacgtgaattagaattagcagacgaagaagaacttccgcagtctcgccgttcaggcaaagcaccacagaaacagcctcgacgagcacacaaaccctcacatgaggtgaactatttacttggtcaagcaaacggggcttatctggttgaagattacgataaagccatttcaagtttccttgaagttatccgactcgatccatatgtaccggcggcttgggtcaccctttcaagctgttacaaagagctcggtgatgaagagaaggccagacagatgagatttttgggtgcacatgtggatgacgagggagatctttggagagaactggcacaagaattcagagagattggacatctggagcaaagtgtctattgcataagaaaggctctcaaatgtgagcctgaccagattgatctcttatgggatctgggagccatatatcgtatccaaggtcaaaagactcgtggatgtaatgttttccgtgcgatgctacaaatcgagcccgaattggcgaataactttgagtttatctccactttccacccactccttgtctcaatgaatctgcggggactagtagcgcagacaaccaggagaggttttgattatcaaatagcaacctatccctcaccgaaccaacgccctcgagtctccgatgctccaccccctatgacttatgagaacataaccaccctcatagacgatcttttagccctggaagagtacgaagatgcgctagtagtcgtcaagcaaggtcagagatggctacagggaagggcagagcagaagggttgggatactatggatgacgatagagaatatgatccaccggggacgatcagagaagaagtggaaagcgaaggattcgagatggatgtgggcatgaggcatcgtctggctctcttgcgtataaagttggacgacgcccacgaggcagacattcacatcgatcacctgctcagccttgacgtgctcacacattacacgtatctccaggaattgggagacgcgctcatgactcgtgatcaatgggagagagctttggattgctttggggctgtccaggaatgtgaagagttgcccgatgatccaccactgatatataaaatcggtgtctgtcagtggaagatgggtgacttggacgaggctttagaggcgttgcaatgggtcatccgtactcgtggtgaacgcggcacactctcttccacgattcaaatgcagccaggcgtaagagtatccaaacggatgcttgaagaacaacttcgttcgcagatgcaaaacctttgggccgatgttcaagaggcagaaagaggtacgatggagggagaagaaggggcgctcgagaggtttgtagagagtgcgggcctgctgattgaaaactatcgaatggatagatcgaattttacgaaaaatcgaggcatggtgagagtgcttaagagcaagaagtacaagaagacggatgtagatgatcaagctgcagaaatgcaagatcgtttggaaagaaccctgggattggaagaggtcgacgatgataatccctaccatgttttccgcaaaacgtctttctatggcttgtccaatgaagagtggttgacccttgtcgtcaaatattgctgcgttttgatggttaggagagaagaggaagtagccatggatatcttggagcacgtcgtctggtcggggttattccataatcggcgttgtgagattgccttgaggctgactatcattgcatgtgcaatgaggctgaaagcctacgacaagatagttgattcggcccgaaaactcgctcttcgttcccagttccttcctcaaccatttctcatcatgcttgcagccatttccactggaggctctgcagcccgtgcagtattcaccgacacctctcttcaaaatttcattaaccgagacatcagagcgtacgacgaggcagtcaggaatggggataagggtctgcattatttggagggtaaaggtagatggagtgccaataaagggaagactaagggagagagcaagggaggcgatggaaagaaaaaaggcggaaagaaatccaaagggaagaagaaagccgatgctcaaattgacccagaccttgatgaggaagaagaggctgaagatcgggtctatggtgtagaaggggagatcggatggggctataaaccagttttacccaagaaattctcgccatatctaaatgtgatattggggcaagagatgcttgcttctaaagccttcaaaggggccatcttctatctgacaagagcatacgaacttgatccatggaatcccttcatctgccttctgatcgcacaagcataccttggacgagccatgacacgtcagtctgataataagaactatcagatcgctcaagggatggtcttcttgtctcaatatcgcaaactttctcctgcttcaggccccgggatggaagaagtggaatataactttggtcgtgcatttcattctatcggtgtaccccattttgcagtaaagcattacgagaaggtgttggatagtgtgcagaagaggatggacgagagtatgtttccggaggaagtcaggaaatcatcgttagcttgggaggcagctcacaatctgatgttgctgtattcaatggcagagaacatggcgctagtgaaagagaaatcaaaatggctggctatctagataaatcccgtcgtctgttgtacatttcccatatgccatgtgccaaaagattgttatttaccttctgttctacttactacaaaagattca

SEQ ID NO: 396 - DNA, 1708 bp, Cryptococcus neoformans var.
agcaggcatagcagagcgagatggtgaatcaaatgcgttcagcgatcgttaaggtcttttcgaccaagcactccttgacattgcctgctccagccctacattatatcgaagaagttcttatagagaatgaaattcccgaggacgaatggatggttggtctcgaattttgggcgaaagagtatttgaaagctgaagattcatcatcattggtgtcattgcaagctttaaaaaaggcctacgaaaatcttcagcttggcacaacagaagacacacaagtagcagacccttctgaagtgaatgttgaatcacacttctctgtcgtggactcttttgatatgcctgccatgagatatgatcctgtacggtcaggttttgttcaatccaaggctcaaccgtctgtcgctggtcaggccagttcaagatcggctttccttcgtgaacgttgggccattatcaaagagatcatccttcgtaacgaaaatttcacaccccctgctatcggtggtcacgatcgtgccaactatctcaaattgacgtcaatccgcaacctcttaggccgtgctggtcagctttttctgttattcggaatgctcgcgcgtaatgaagagggcaagttgtgccttgaagatggagaaagtcgagttgttctggatatggaagatgctgttcccggtgaggggctgttcactgaggggtgtatggtcttgatagaaggagagtacacagtggaggaaacggttcgcgtgttggctatgggacaccctccgagtgaaagaagaaatatcgcgaggtccttacatgggcacgtggacttcttgggaggtggtgctgtatctctgaaagaagagcaaaagtacaaccccacagtgcttgccaacactcagatatcttttgttattctgtctgatgtctggctcgatcatccgagaactatgcctgccctgcgccagatgtttgaaggatatgccaacactgccgagtaccgaccgatggtgtttgtactttgcggtaacttctgtcaaggcggatgggagggccaggaagggctcaaaagatatagccgagggtttaattctcttgcagagcttcttcaatccattcccctgcttcattcctcacattttgtctttgttcccggcccttcagacccttggtccagcactacccttcctcgtccctctcttccttcagcattcaccacgcgtttatcaaaccgtataccgaacgcaagatttgtcagcaacccatgtcggctgaagtactttggaatggagattgtgatctgtagagaggatttgatggggaagatgatgcgaaacttagttgtggtcaaagagggtgaggagatgaacatgaagcgatatctcgttcaaactattttggaccaagcacatctctcgcctcttcctatttctgtccgccccactctctgggaatacgatcacgctttgcgcctgtaccccatgccttctgccgtggtcttggcagataagtacgaacgatatgagctcacttacgaagggtgccacgtttttaacccgggaaagtttgttggcggaatcggagaagatgggtgggagtttgaatggagtatgtattatcccgctacaggcagaagtgagcgaagtgtcttgaccatggaataattgtttcaacgttgatttgggccgctgttgtactataagatcgtcatgcattataacatatt

SEQ ID NO: 397 - DNA, 2127 bp, Candida albicans
atggaagtcacttctttgccaattaaacttcagccatcaaacattagacccatagcatttcgaatattgtctaaaaaacatggattaaatattaatacagatgctttagcaattttaacagagaccatcggctacaaatttggaactgattggaaaagtgtgagatcacaacaatttcttgaagaggttgccaaagtttggaaaatcgaagatcggggactatttattgatggcgatgggttaaaacaagttttgaaggatatgaattccaaaagcagcaatgatacaaaaagagctcatcgaactgacaccctagttgatatcactaatgatggtaaccaaaatcatactcatagccaccaggataagcaaataagttttgaagataaaaatatggaacatgaagaaagagatgatgtaccaatcaactggcaagattatttcaaagttgtatctcccaataaccaacctactagtatattcgacaaaacaagaaaacaatttgacatagtatttaaaaataatgatgacaaggataagaaagccgagcgtggcgggaaacttgagtcaattgtggcagagttagtaaaaaatttgcctgcatctattgaatcattcaataatcgatactatctcttaagtgatcgattatcgagaaacgaaaattttcaaaaaaaatcattaatcagtctatcagcgttaaattctttcaaagaaggaaaaacagatagtataactggtcatgaaattagtttaatcaaaaatatgttgggtcgagatggtcaaaaatttttgatattcggtttgctcagtaaaaatgcaaacgatgaatacacattggaagatgaaacagaccacattgaattaaacttatctcaagcttttaaatctcaaggattgttttattgtcccggaatgtttctattagtggaaggtatttattctgcaagtgggggtaattccaaccaggatcatggttatatcggaggatgtttttatgttagtaatatcgggcacccaccaagtgaacgaagagagacaagcttagatgtttatgggaatttggattttttagggatgcatagacaaattgcacctgtgacaggtgaaaaaatcaccaaaatatctaaaaagtttaagaagagattggttctaatcgaaaagaccttgtataatcataaacttatttttgtgggtaccgatttatacttggatgatttcaaagttttggatgggttgcgaaagtttttccaaaaattagaaaattcaattattgaatcaatcgaggacgaagaagggcaaatggccgaaggaaccaatataccacttgctttagttttcacagggtcatttgtgtcaaaacctttatcagttacaaattcatcagtgaccaacatcaccaattcagaatcatacaagagcaattttgataatttcacaacaatcgtgagcaaatacccaaacattgtatctcgctgcaaaataatattgattccaggtaaaaatgatccttggcaatctacttattcattgggatcatctagcttaaactattttcctcagtcgtctattccaaaagtgtttatcaatcgattggaaaaattattgcccaagggaaatttagtagtttcatggaatcccacaagaataaattacttgtcacaagagttggtagtattcaaagacgaattgatgaccaaattgaaacgaaatgacattattttccctcgtgatattcaagaacaagaagagttgattgcacaagatgaccaaagaactaacgaggagagaatcaataatttaatccagaataaaaatactcatttgccttcaaaaatcaaacaggcaagaaaactagtgaaaaccattttggatcaaggaaatttacaaccattcttgaagaacctaaaattaatcaacttggcttatgattatagtttaagaattgaaccattgcccagtgtaattattttgaacgattcaagtttcgacaattttgaagtgacttataatggttgcaaagtggttaacattacttcagttgtcagcttgaataatagaaaattcaattatgttgaatattatccaggaactaaaagatttgaatttaaggatttgtatttctaa

SEQ ID NO: 398 - DNA, 5133 bp, Candida glabrata
atgaagtggagcgtatcacaatttagtgatctttatgcttccattgatgctaaggcaattagctccgagctattcactcaattattgcctgatctgaaagaacttctcaaatatccaccaaagaacaccgaatcacggaacaaactagaaaaactacaagattacaagaccgatgatgggtcaatcttcaaattgaaccaggatttcattatatctataatctcattatctgatgaacttaacttagatgaattagaggcagtgaatttggtattagaaaattcccctgggagtcaaatatatgcttctgaagtagttaataatggtaaaatatcctttttcctcagaaggcaatacatacttcagattgtgtcttatatctgcaatgctgaagatgttatgagtccttattataaaaagttctttaatgcagaaaccaataccactattttaagcaaagtcctggagaattttgatataatatcgaaacacttgtcagatatcaagcaggaagtgaatagaaatcaaatccttgataacatgaatccattgattactcaaggcattcattttaaaagggattttttctctaaagaatatgatttacttagtcaagtgctatatggattgtcaaaaagatcattaataaatacacagatcagttccgttgatttgattattgaacattcattaaaaatggaaactaatgacttcttcgtggtgtattttcttccaacgttattaaacttattttctaatcttaacacattctctgatgtggatatattcggactgcacaagaagtatactaatgagttgataacaaaacaagagcaagtttataaaaaaccaatgaaggtattaattatgtttatttttctaacatttttgattggatggtgtaaagaagacccccaaaatagagtaacaaaactgaatttcaaatccgatattgatgaccccatgactatcgcagttgaattaggtgcaattgaacaactactgattgtaatagctgatttatctcggatagatgaatcaacagctgtacaatattatgattttagggcacttttggaaagacacctaccaagatttatcccattacagttagtggatgaaaatgttatacagaagtataatcaaatgtctagcttgactgaacgttctgacagcacaaagataaatggacctcatgaaagctttagcaggaatacctaccgtcctccttcaatgatttcacctaacaactatagcaaagacaacaggttcacaaatgggttaggatcaacctcgattagtatggatagattaaatgagggaagggtttttttctctacttcagatatgaataaagaaatttcaaagtttcgtgaaaatatttccgaaatgtttgagatgtttctagaagaaaatatccatcatttcatccaaacatttatttcagattgtgcatttttgctaacaaaattaaaagacgctgaagaggactcgttattgtccggtgaagatcttgatttggatgatatagcaaccaaagcagatttagaaagattctttgtgtcagtattttacttctattccaagagaccacattacgtagctgctttttgggaagacaaggaatctgcagcatatggctttgttgaatgggcttcaaaatgtaatgataatttgatgaagtcctgcttctatttaatgctaggtgggttatcatctggtaaagagaatgctttgaatgtctattactaccttggtgactccaatcccacctcttggaaaagaatagctgatactatcggtagctattcctctaaaatactaaacttagggaaagctattcaagcaaaggaacaagaaaatgagggtgagctcaacacaacgctacttgctttagaagaaggtttgaatgaagaaacaatagtatttttgtcctcattgctcactttgataagttctgtagcggatcaaatggagcctgatgagaagctaatgttctctcatttatttgttgatgttatctttgagttaacaaaatgtgaaactcctctggtaggtgcctgctttaatacgatcagtacactggtcccaattttagaaagcgacagagctagcatttggcataagctggatagcactttattcaagggcgttgccttgtctgacacatcgcagtatatttctgccttcagttcgattttgactacatactctgatgtccttggatttcttgcattgattagaaatttactacagattgaatcttttgattgtaacaaggagtttctagtatttggacatctacaatatccaaatcagttaggtcgtccatacagaaagtcgggaatttggccttacttagaatttgtaatgaatgaggtatttgtcaactcagacaaaattacagattcatttaaaagacatgaattacaggaacgtgtgcttgaaataattctgacctgtttgaattcatttgactattctgtgctattaaactctatttctgttggtgctaatttagacaaccttgttcatggtgagaattttgcaagttatgttcaggataatgcagcacctgcgatgttcaattttttgtttcaggaaaatgtatatacaaaactatactccattgcatcagtagggatagataattcctcccttttaaaaccacacagtcagctgcaaactcttttgcgtctttctttatctgttatagagagaacattggattacgaaaagacttatacagaagaattgctcacaataatcaaaaaatatcaaagcggtgaattttataggccaaaatactacggtcttcacggtcttgtatctttcacgcaaacagttttcttcaatttggattttgtcacttgtctagggttatatattggcctggacaatgacagtattcctataatctcgattaatatcttacgaaaattggcactattatttaattcaacagagcctgatccaatattgggtaacaagttatttacactttttgattctattgatgagtcagcaagaatcaaagatgcttttattgatcaacttgattgtcctatcgaaaattcagacaatttaatgctgaaagtggagattcttgaatttctaaaagacagtttggatatcgaatcgtcaaaacctagtgttgcacatttattattgggctttcaatatgataatacgctaacttttgggcccaatttaagtacttttattcagtctgggcattcactctttcattcggtaattagacttttgatttctgctttgaatgaactgtccagttataaaattgattttgcaccaatgcgattagcagcattatcgctgcaattattagagctcatgtgtaaaagtcagttgacatcggatctggtaattgaacatatcacaaataatgaaataataaagaagattatggatgttgatccccaaacgtcaaatcacactttgtggaatggcctaaatttggaatctactactcaatcaaccaaggcacgctttattcaaggtagctcggctggtgcatatctaatgtttttgagatacaggacatcaatgattcagttcctaaacgttgttattcatactatctcattgaagggtaccatttcaagagtagcaccgtatacaagttatctgatatccaactctatctactctgctcgaattttttctctgttgcgtcccctacatcaaaatataatcttaaaggaaaagatagtgccagaaaaccttcagcttctaaaggatttgccagttgatttggataaagtccagctaagaaaaagttgcacaggaaatatctatgattttgatgaaattagctcagtacttgaattacatagtaagacttattctgtgtctcagctaaactcaaaggaatttatggataagatactatccgagtttgaagaggtaaagcaacttattactctatttctagtaagaaaggagtcattttctcaacagctggctattcttcataactgggtccaacttgttcaaatcattgtatctgacggaaatttgggtgagaggaaaagatctacatttattctggaggtttttgatatggttactccaaaaataagtgtttatgttgatatcgatgttaagtttgcagaagaactggtttctctaatggtattcctattccatatatataatcaatcgaatgcaagctcatctggaaagtattttctggactctaaactgcacaatttattccaagtatgcataagagggataagttctccattgtcatccttgaaactgagatcagatttttacgttattgctaacaattacctactgcgggttttgaaaaactctggtatggcttatgcgatagtgaaggatttacgcctaaataatgagaggctggtagaagtgatttgtaacgacgctatttatggagaaggagcaattaagataacggggttgttactcctggattcgttagtacaacttggaaatcatcatcaggagaatttcatagttatgactttaatgagaagtacaaaattatttcacatcattcgttctttgaaagcgacagattcactactaaatgcaagcacagaaaatgtcaatgttgagaatttcctgtatgagctcactgctttcaaggcaacagcatatttcttgataagaattgcagaaacaagagaaggtgctgtagcactgattgaaagcaaagtttttgatattttagctgagctaaatttcttgaagattgatccggacctaggacttgagttagtatttgacgaaacttctaataatacttcctctttattgagagtaaacattacatttgatgaacctctaattttgggtaaagaagcgacttcggtctcaatttttgaattgataattccaattttccagctgatgcttgccattgttatcagttcagggagatttaatgatgctgtaagattagcaaccacttccttgttgaagcagtatcaaaaattgatcataggtacttttaagagagatacgctttataaatctggaaagaagcaagcctcggatgaattgaaatataaacatcaccaagaatttatcaagcttgttgttttaatctgcaccatcaccaaatatgaagataaataa

SEQ ID NO: 399 - DNA, 693 bp, Paracoccidioides brasiliensis
  misc_feature (646)..(646): n is a, c, g, or t
  misc_feature (663)..(663): n is a, c, g, or t
ttcggcacgagggctgcatgtctttgcttacagggaaaatatggcatgcacatcaagatctacataaagcagtggatgttatgttgaagctttgaaattaaaccctttcctttgggacgcctttctaggtctttgccaaacaggtgccaatatccgggttcccaacatatataagatgtccccagatatgttagcaatgctcccttcgtcgccaaccacagaaaatcctccgacattcgaaaaggctgcacagacaaatggacccctgcaagtacaaccaaacataaaccataacgtagatccatttacatcgttcagtgctcgcgttgatgctgcaaatggttcctccgcactttgggaaaagttaaatggcagtaatgtcagtgtttctatcggtgctcccgcgccggaaggtttggaaactcctgtcgcccaaagcgattcggacgacttgcgtgcaggtggcagtggtggtgcaacttctggtgacccatcatgggaacccacttttgcacctgggaggaagaatagaactattcagacattgggtttggattatggggtagatccacccccaaaaatgaagactacatcaacgaaaatcagaaataaggcagggtagatccgaagatactatcatatgcanctcagagaaaagcccgncagattggaggagtgaagaaagaacgttcg

SEQ ID NO: 400 - DNA, 434 bp, Paracoccidioides brasiliensis
gaacaccgcagccaacgaagaacgctgtcagagctccaatctatgatttcggaacttagcgccgcagataaatctctatcactagtgcgttcgatgttaaagaaagtatacggatcgtctagcgatgccgtcttggctcctttttggcttaccctctcatttattaagagtattccagcagatatagcatcactggatgacatgcttgatctggattctgactcaccatctcgcgctgccattgtcgaggagctttactcaatttcacttccgctactatcaagttctaatcctcccgattggcgtctccctgcgttagcccttgaagctgtagcacttcaggcacagcagcttggtgaaacatttcggccagagttgattgacaccttataccctgtgttgcagttgatgggctccaacaatcctaacttgcg

SEQ ID NO: 401 - DNA, 3162 bp, Candida glabrata
atggatcgaggccaaaccgttttcaaaaagctaagagaaccatgtgttttagtgtctagggttgcctttcttccaagggaatcttttgatccaaattcacctctactgatcgattctttgaaggaattgtctatttgtctgagtgaaattaatgatgctgatgatttaccttccaatctgggggactatgtgtacctgcctatttcacatttattaaagcaggactcattaggtgatgtggcaattgaatatgtgtttaagataacaaggatgattctgaagttattttggcacaaatctggatctcttgataaggaaacatgtaagaaattgttcatgatcaccaactttttaataaataatgatccatcatctaaagagtatcttaagaagtcatcaccttataaattagaaggcatcaaattattgcaagaattactcagatctctgcagaaacaagaataccatagctccttttttgtagaaaaacctgaaatgctatcaattatgacgcatatggtatcgatctgtctggaaatgttaaaatcagagccatttgtgatcgatctgcaattgcaatgtattgaaacgttgagaactctttatgttgaaatactacctcatggggaaacactatcatatattttaccagggaatatatctgctttagttgctgttttaggtaagccggggcttttgtcaaattcagctgttattattgggtgcttaaaattatattcgcaattgctaataataatttacaatgataaagatctaggagtaaaggaaaactctgcgaataatgggaggatcatcaatacaattttagagcaagaattgaaggaaaccccgttggatccattctccttaaaattgcctatactgggtacaaacttaaacacaaaaagggtgcatagagatactagttggctgaaaggaacttcatctcaaataagactctctttggaatcattcctcacaaagttatgccgtagaaatgatagtaggataaatcatgaactttcaaagttatgtggcggcttgctagctaattgtaaaagctctctatgtacgtcggtacctctattggttcgaaccctcatatatcttaactcgaaccctcagaatatactgaaatcttgcataaatgaagttagaaacatattttctgaagaggtggaaaacttgaattcacaattgaaggagagcacagaaggaactttgagccaattgttttttttagtgaaattattggagggggatagtgagcttctccctggtattaccaagtgcttagttagcctgaaaactcatgttatgaaagaaattgatatttatgatgcatctacaaaaaaaattcaaacaatagatcaaaaatcggaagtgatcatgatggataaatgggaattggatacagcggaaactggattacttacaaacgtaatagggactgaggaaaaaactgtggcaagctttctcggggcacttgcgcatgaactacctgcccaaagtaaagaacatgtgattgaagggttgctcaatgaaatggattttacttctctatccgataaaattacaagtatgtggatttcaagtaatttactaaatggtaagttatctattagtggatcaaatggagtggcaatggatagcttgactggaacagggttgaatagctatgcatcctacccaacagttgcatatcaacttttagagtgtgccaaacaatgctatgaaggacttgagatggagatggaaggacaaaacggaacgatatctcaagagattttagtctgtacaatccttagatctatcactactgttgttgagactattgggaaggattttcaagatgaagtcattgactatatatacattataatcgagaacttagcttcatcatctatgctcattagggaattctcaaagaggagcgcgatagtactggccaaaatactatatcataattcgatatctgacatgattacccaaaatacggactatataattgatgcagtttcaattaaacttgcctcgggtatgacgcaaagggttagtgtagttctaatggtcatctgtaaacttgcgggttatgaggcaattaggagtttcaaagatgtcatagagacgttgtttaaaatgctcgacttttatcatggttattctgatctatgtatacagtttttcaaagttttcgaaataatagttatggagatgcagaaaacttacttgactgccgataagaactgggataaaattgaagataaagccagcaacaagagcacatttaaaccatggggaattgcaaatgtcgagcaaatatgtaagatgttagaaaatgagataattattgatatcgaggacggtactattgatattaatgaagatgacgcattgagtgaaataaataatttcaaagattatgttaatagaaaaatggaacttgagaatagtgatagtgatgatgatgatgatgatgatgatattgagaattatgaagatgagggaagccataacgaacttgaggagatgaagaaaaaaaagaagactagtgaagaatgggtttctccaataccagtcgaatcataccgtgtacttttgcagatcatatcatatggtgatagactgttgacacatccatcaaaagagcttaaaatactaattctaaatattttctctcaaatatggcctatgctagccacccagtattcttcactgttaccacaagtggcccaagcttggccgttaatttcaactttaacttttgattcagactactctatagtagaggctgcatgtgtttgtctaagaatcatgattgaatgtagtggtgattttgtgtcaaagcgttttgttgatctctggaaagaggtgaaggctcgatcaatattactcaaagagataaaatattcacaaatagagaatgggcaagaaactacttctgtagtagttttaaatcgtattcgttttcctcctataacaatgaaagctcttgcagctttaaactatatgttgctagagggtattattattgctgagctttttttgagtgatttggatattagagatatgcttcactgttgtgttcaaagtataccgaaggatgagattgaatcaaaatctctacatctaggagacgtgcttttcgacatgaccatataa

SEQ ID NO: 402 - DNA, 641 bp, Ustilago maydis
  misc_feature (3)..(3): n is a, c, g, or t
  misc_feature (25)..(25): n is a, c, g, or t
ggntcgcctgcaggtccggtccggnaattcccgggtcgacccacgcgtccggaactgaccatttccagttcaatctgttgaagcggacaagatgggcctgtcaggaccgaaacagaagcagcgtctcgtgggctctgccagcacgcgcaacacggcctggctcaacgatgcggcagcaccgggacagcgcatgctcgcacaaatgggctggtcggcaggccaaagtctcggccttaccatgcctggtctcaccgagaatctcaaagtagcgtacaaaatggacaacaagggtattggtgctcagcgacacgaacgcgaagcgagagcaaacggcaaagacatctgggtcgggggtggtggcgatctgggtagcttgttcgagcgtctcaacgctgctaatgccgcctcttcatcgccttcggcagtagcttcaacatcctcttccgccgctggtagtgacgatgaatctggcaagaagtcaaagaagaccaaaaaggaaaagaaggacaagaaggacaagaaggacaagaaagacaagaaagacaagaaagacaagaaagacaagaaagatcgctcgaaagatgaaagttccaagaagaagcggaagctcgacgactcagacgacgcatcgagagaacaga

SEQ ID NO: 403 - DNA, 2184 bp, Ustilago maydis
atgtcgtacgcaggccagtctagcaaggcctcctcctctctcgatccaaggtcgattcgcaccgcaagctcgtccgcgtacccgaaccatgcaggcgtcggaactcaccatgacagcgaagtcgcattcgccgagctgcagatgctttctcagaatcagaggaaactcgccacgctgaccggtcgcatgactacgattctctcgggttttgacaagcgcctcatcaagctcgaaggcagcatcttgcccatccacaagggcacgcagaaacttgcgcgtatgtcggataacattgacctaaccttatccgccctcaacaagacgcttggacactacgatgttgtcattgacgaacagccgcttctaaagcaaggccctgatgccagtgatacacgtccttacatggacaccatcgaccgcgtcattaaaggtctcgactacctgcagaaatccaacctcaagagtcaagaaggcgtcatgaaacgcatgaacgaccttatcgagcttggcgctcgcaacctctgcactgtcatctcagactgggtacgtgcggattccgaggccatcgacttgtccgagtacagtcgaaatgctcactatcccgtgctctccgaaacgacacacaacgcaattgtgcctatatttaactacctctccacgctaccacaacacccgcgtactggttttgcgcccatgtcggctggcctggctgtctatgccagcgtcaggggcgactatcttaaacagtgtctcgctccattagcagcaaggttgcagcagcacgctctcgaacagatcggtacgggcgtcaccggtgcaggcatggtcatggttacgcaagacgatgattttgacagccactccaactaccgccgaggccaagctggagccgtcgagctgttcgaagcgtactacggcatgctcgacaacgattatcgtatcttgcagggacttatgacctcggctgagctcgacaagcagacgctgttgcttgcctcgacattttcgcaacttgcatcgcaacctctcacagctctcatcgagtcgctcggtacggtgcaatcgcatgttcgccggcatctagccactcacacctctttcttgctggatctcatcggcgctttgtctgggatcgttctaacaggtcgatgggatgtgctacttcgtgccatggaagattctccggaagcgcctttgcatagcacatcgcccattgacagagcagagctggacctgaataccggctttgcacctgctgccgaagttctcgagatctacagcaagctcaagaacaccgccatcggcatcttcccgcgcttcattgaagacgtcaaggcaattcctgcacgaaaagtgtctgaagtccctagcacctcggtcaacgaaattacttacttgggacttcagttcatacgacagattaccgagtacagcgacgttgtttcgccgctcttgcacacccttggcaacggaaactggatgatgtcgagtggtgtagcaccgattctctcgttgggacttgatagcgatgcaagcaagcagagcatcgtgggcgactatctcaatgacgttgtcgctgttgtgcttacctcgcttgaggctcgatctcgcgccatccgccagccctccaccgcctccgtcttcctactcaacaacattggacatctccggcggtctgtatctgcaccgttaccgagctacctcggcgcagccgaagatggcagcagcgtctcgattatctcgctgcatctgggagagatgggcaacgatctactaggtacagctttgcggcaggcaaacacgtcatatctggacgcctggtctcctgtcgttgctccactgatggacgatcagcctctgaatgctacacagtatcaccgtcacgccacatctaagctcatcggtgttggatccggatcggaaaagaaccaggttaaagatcggttcgctagattctacgaagctctcgaagatctggagcggctgcatcgcgcgtatccggtcaacagagaggatcacgagctgaaagagaggctgacaagagatgtcactcgcctcgtctgtcccatgtacgctcgcttcttggccaaacacaaggcaagcgatttcacaaagaatccgagcaagcatattcgcatgacagagcaggaggtcgaagacaagatcgctagcttgttttgttga

SEQ ID NO: 404 - DNA, 1872 bp, Candida glabrata
atgaacgagatagatgtcgatgaagccgatattcttgttctttcgcaagggctagagaaaactagtaggcttacacatcaggtaaataagtcattagcgaagatatcgaagacttcggctcaatcgagtcagctatttggcccgatactagcaagaaataatgttctcaaaacattacaaagaaatatcgatagtaccctgaactcggtggcatcagtaaaagatttggcaaatgaagcatcaaaacatgaggttctgttaaggaaaggtattgcgagcttaggtttgaaaccatttacggtcgaactacacaaattagaagacatgtaccaggacatgagtgtaggaaattcgaggcatactgaaaatgcagagtttcatggtattttgaaacacttaaaagaaatgataacatcgtcagaggaacagttagaattggaatttattcaaatactgaaaagaatagaaccatttgatccacagataaatatggagaagaagataccatttccttactattcagatgaagatatatcacagatgttaattatttttaactacttttatgtgaaatcagaagactcaagaatgcaggatatttttatcagagagagaggagaccaaatgctgaagtcaatggcttttatggaaccattcgcaaaaaaggtaacttcaagcaaaaatgctccttatgagaaaggtagtagtggtttcattaactacactgaggccgtacttggatttattgctaatgaaaggtccctaatagatgatgttttctcacaatttgcagaaataaaacctagagtcctaagaaatattttggatccaatagttgcagcattttgcaaggttttgatgagtgacttaatatttgtcaagtcaaacatcgataatgctgggttgttcagttttgagcttactgagtgcattagtggagtccaaaaaagtgttaaagggatgaacttaaaaaatcaaatgcaattgattgatgctgacaagcaagtcaaagatgtaacaagatctttgtttaaagatacagttgatagaattaaatcaaaaacgaaccagatgacaactatcccttcagacaatggtgttactgaagctactgttgacacaatgtcgaggttgagaaagtttagcgaatataaaacaggatgcttggcagcaatggaaagcatatcgcgagatgtgtggctgtctaaatcgttcagagaaaaagagtatacgatccaaagtgctgctattgcagataatgaaacagcggcttcacttttatcatgttttttaagtgattgtattgacactcttgtagcaaatcttgaaagaagagcacagactattttgatgccaaatcaagaaccagatgttgctaatccaaatagtgccagaaataagtttaaacaaaggataggtttcttagtattgatgaacatgacattagttgagcaaatagtcgaaaaatcagaactaagcgtaatgcttggtaatttaggcaaagccagaatagaaaaactaaaaaagagatatgtcaactacctagtcgcagattggaaggacttaactgtcaacttaatggataccgttgttattgatagtgtaggtaaaaaatcgaaagacaaagaacaaattaaagaaaagtttaggaggtttaatgaaggttttgaagacttgatatcaagaaccaaacaatataaactctctgatccagcattgaaacgcctactcaaaagtgaaattgtggctttattgatgccaatgtatgatagattctatggccggtacaaggactcattcaaaaaccctagaaagcatattaaatatacaccagacgatattacgaacgtcatttcgcaaactttgaggtag

SEQ ID NO: 405 - DNA, 706 bp, Phytophthora infestans
ccggtccggaattcccgggtcgacccacgcgtccgggccaagcaggatgcgcagataagcggattgaggatggcatggagcgcatgaaggtgttggatcgatgcgttcacagaatggagtggcagcgaactgagcaggagcgcgaggacaaggaggcggcggagggtgatgctgagcgtcgagcacttgcgcaggttgactggcacgactttgtaattgtggagacgatcaactttgatgacgacgacgacttgggtgcttctgctactgttggagagggtgaggcgaagggatccgatgatgatatggacatggaggaggacgatgacgatgaacccaagccggaaattaaggtggtcgaagattatgtgccgcaagccacggcagggacaacgcagcaaccgctgctgagcgtggatggcaagaccctatcgtctgctgaggccaacgagcatatgcgtattctactgatgaacccaaagtggcgtgaggaaacgcagcgtcacttagagaaacagaaagagagctcgtacgcagcaggatcagcgatcgcagactcgctacgacgctttgcgacgaagcgtgcagatatatttgcgtcgtcagccgaagaagaagcgcggttgttgcaagccactactgcgccgaccattacggaacaacggcaacagcagcaggaagacgacatggaggacaattctgacga

SEQ ID NO: 406 - DNA, 377 bp, Fusarium oxysporum f. sp.
gcaggaattcggcacgaggtttcaattcccacttccacttccgctttcgtttccgccttcacagcatccatcatcatccacgcacgttggggtcaacgtcaacaacaccaatctcgatcacgatataacgaagacatcacgaccagggaaaaggcttctctccgccctttgcacgccacccgaagctaggattcgaggcatacagctctaggacgaaggattacaagcacgatttaacttccttactactgcttctctttcaatagatccaagatggattctcttgtttcgaaatacagccgaccggcatatgagcagaatgagccttttgaggaccaggatgagctgctgaattctatgggtgatctctcgctcaa

SEQ ID NO: 407 - DNA, 763 bp, Phytophthora parasitica
ggctcctgctggtgcattgcctattgcggcccttcctggcctcgtccgctccgtcggctgtagatacgcggcccatgcgcagactcgaaccgcagtctactaccgctagcaactctcaatcgcccaccaagtcgcttgtcgccgccgtgctacagcgactctcgatggacctccccgccgctcccagtgtgaacagcgacagcgcgagccccacgaatagcagcagtgaaccgtcgccccaggcggcagacgccaagccaaagactgcgccgtcgccgccgccgtcgcctaagatggttaagacccaggaacccgttccggaacaggagcaatcacagcagcaagaagacgcggacatcgacgacgtggaggagctcaagcagacgctcctgcgcaagtccacgggctccatcgccatcatgacgcggcagcaggaggcgttcgaccaccgccgacacacattcagcgccatgtcggctgacggacgcgctagcatgcgacgacgcagctacgacctgaccgcgcagttcgggtcaacgttcccgcccagctcgccgccgcagccgcagccgttgccgcacacactcaaggcgcatcaccacctgcaacacttgagagtgtacggcggcttaaagaccgccggccccgccaagagtatcagcgagtgccacgaagaagggacccccatggtggcactcgtaacgcccaatccggacacagtctggacacgaggcaaacccgtaaacatcgagtggaaagtgct

SEQ ID NO: 408 - DNA, 1902 bp, Cryptococcus neoformans var.
atgaatatcaaggatatgtctattataacatccggcgcccccctccacacccaatcatacgaagtatccatccctgccttatctatccaaactgtccgcctctccgccttggcgcccagcccgggtattgttcaaatcaggggtatctcccttcgtctctcggacggttctgccgcagacttttaccttccccttttggacgataaggaatgtcaaaagagggaacgacagcgtcaaaaggaacgaatacgatgtcgagatgcgaaacggtcaggaatggacaggaggaccgcgtgggaggaagaaattataatgaaagaggagaggatgagagaagaaaaggaaaacttggagagcctgaagtggttggagtgcgaggtagtggaaccgttgccgctggcttggataaagagtacaactttgacgcatggaatggcgatgctgcacaacggtgaaacctcgactattcagatcacactcgaaaacacgtcccccatccctattaactaccttaaactttcattcgaagactctactgtgcgagcggcgacgagggtaatgcaagagaatgagctaggagcggaggaggcgtacgagttggattgggatgtgaggaataggagtgtttttacgtgggaaaatcccatgaccctaggtgctggggagggggacgaatgtctcatcgtaccgggtggaaggaaagtgttgaagataaaatgtcttggtaaagtaggatgtatcgaggggctcgtacggattgactatggccatgttcaatctatatctcgaggttcgacccaaacggacgatgccgacctccttacacccataactacatccgcaaccttctacacccgacaaatcacattccctgtgctgttcacagtgacgcataccctcgaatgtcactccctcgacatcacccatctcggtcattgtgcgaataatggttactctaccccaggaattaatggcaccaataacctcgagattccggaggaagataacggcgacctgagaaaggcgttggcacgggaaaacaatttgacgcactgtttggtggggttgagcgttgccaacgtatatggcgtaccatttgaagtatgcttgtcccgcaaggacaaaagggcgaagagcgaaaatgtagagtgtagacggcttatccccccgggagctaccgaaaggttgatcgtccctatacctcgcaaatcgatctcgcaagacatcctttctcaaccaattccttccctctcagaacgacagtacgtggttgacaaggagaagaaatcccgttcaaggattgctctggagcgcgaacttttttggtaccgcgaagcattattggatatgctggatctgacttggacagaacccggatcgcaaagacacggtagccttatactccgaaaccaaatcctgactcctagtttacttcaagttttcagagctgacgccatcgacattcgtgtgattttgcgaggacgagagaaagatggtgatgtacaagcaatggattttgttgatctcgtggttgaggtgactaataacttggaacgcccttaccgtccatacatcaatctcgcatgtctccccacgtcctccacagactattcttgggctcgtccaacttccatctaccgtcctcctcccaccgaacaacattcacacgcacaccctcatcgaaatgtcttatttgatagttacccagctggtcctttgacgatgttgcaaaagggcgagaaagatgtctacgaagtgggcatgacgttcttagctagtggggagtacggcttcagagcttcagttgaagagatcaagagaaaagaccgagaaggggacgtggagcaggttggagagagaaaggtctggttttcgccagtgttgcaagtccaggttctctaa

SEQ ID NO: 409 - DNA, 855 bp, Magnaporthe grisae 70-15; identical to SEQ ID NO: 1

SEQ ID NO: 410 - DNA, 1537 bp, Pythium ultimum
ctgggacggtcaaagcacggtactgccagccaccgagccgccgccgcaggagaagcacccgagttcattcgcagcgaaacagacagacataatgagagaactagttcacatccaaggtggccagtgcggtaaccaaattggcgccaagttttgggaagtgatttctgatgaacacggtgtggacccgacgggtagctaccatggtgactccgacctgcagttggagcgcatcaacgtgtactacaacgaagctacgggcggtcgttacgtgcctcgtgcgatcttgatggatttggagccaggtaccatggactcggtccgtgccggtccattcggtcagcttttccgcccagataacttcgtcttcggccaacccggtgctggtaacaactgggccaagggtcactatacggaaggcgctgaattgatcgactcggtcttggatgtcgcccgcaaggaagctgagagctgcgattgcctgcaaggtttccagatcacccactccctcggtggtggtaccggttccggtatgggtacgcttttgatctctaagatccgtgaagaatacccagatcgtatcatgtgcacgtactcggtgtgcccatcgccaaaggtgtcggataccgtcgtcgaaccatacaatgccacgctttcggtccaccagttggtcgaaaacgccgatgaagtcatgtgtttggataacgaggctctctacgatatctgcttccgtaccctgaagttgacgaccccaacgtacggtgacttgaaccacttggtgtgtgctgccatgtccggtatcacgacgtgcctgcgattcccaggtcaattgaattcggacttgcgtaagctcgcggtgaacttgatcccgttcccacgtctccacttcttcatgattggtttcgcgccattgacctcccgtggttcgcagcagtaccgtgctttgaccgtcccagaattgacccagcaacaattcgacgcgaagaacatgatgtgcgccgccgatcctcgccacggtcgttatttaactgctgcctgtatgttccgtggccgcatgagcaccaaggaagtcgatgaacaaatgctcaacgtgcagaacaagaactcgtcgtactttgtggagtggattccaaacaacatcaaggccagcgtgtgtgatatcccaccaaagggtctgaagatgagtaccaccttcgttggtaactcgactgcgatccaggagatgttcaagcgtgtgtcggagcagttcacggccatgttccgtcgtaaggctttcttgcactggtacacgggtgaaggtatggatgagatggaattcacggaagccgagtcgaacatgaacgatttggtgtcggaataccagcagtaccaagacgcgacagcagaagaggaaggtgaattcgacgaagatgaagaaatggacgaaatgatgtagacgacgcgggcgatatagcgactcctttgcagcagcggttgtggcggcgtcgagatattctccaagtaccatacaaaaaaaaaaaaaaaaaaaaaaaaaaaaaaa

SEQ ID NO: 411 - DNA, 1666 bp, Leptosphaeria maculans
ggcacgagccaacaccaccctctaccaacttcttgcgcattctcagctcccacccaacacctttacctcagcaccacatcgcccaccgccatcatgcgtgagattgtccacctccagaccggtcaatgcggtaaccaaatcggtgccgccttttggcaaaccatctccggcgagcacggcctcgacggctccggtgtctacaatggcacttcagatctccagctcgagcgcatgaacgtctacttcaatgaggcttccggcaacaagttcgttccccgtgcggtcctcgtcgatctcgagcctggtaccatggatgccgtccgcgctggacctttcggacagctcttccgtcccgacaacttcgtcttcggccagtctggtgctggtaacaactgggcgaagggtcactacactgagggtgccgagctggttgaccaggtcctcgatgtcgtccgtcgcgaggctgagggctgtgactgcctccagggtttccagatcactcactccctcggtggtggtaccggtgctggtatgggtaccctattgatctccaagatccgtgaggagttccctgaccgtatgatggccaccttctcggtcgtgccctcccccaaggtctccgacaccgttgtcgagccctacaacgccaccctatccgtgcaccagcttgtcgagaactccgacgagaccttctgcattgacaacgaggctctctacgatatctgcatgaggaccctcaagctgaacaacccttcatacggtgacctgaaccacctcgtctccgccgtcatgtcgggtgtcaccacctgcctgcgtttccctggtcagctcaactccgatctcaggaagttggctgtcaacatggtgcccttcccccgtctccacttcttcatggtcggattcgctccccttaccagccgcggtgcccactccttccgcgccgtcaccgttcccgagctcacccagcagatgttcgaccccaagaacatgatggctgcgtccgacttccgtaacggtcgctacctgacctgctctgcctacttccgtggtaaggtctccatgaaggaggtcgaggaccagatgcgcaacgtccagaacaagaactcatcctacttcgttgagtggatccccaacaacgtccagaccgctctctgttccgtgcctccccgtggcctcaagatgtcctccacctttgtcggtaactcgacctccattcaggagctattcaagcgtgttggtgaccagttcactgccatgttcaggcgcaaggctttcttgcattggtacactggtgagggtatggacgagatggagttcaccgaggccgagtccaacatgaacgatctggtgtccgagtaccagcaataccaggaggcttccgtctccgacgctgaggaggagtacgacgaggaggctcctcttgaggctgaagagtaagcttgccaactgtaatacctcgctgggcttgagtattggtattggtggtctactataatgtttcgattcgtcctttgagcaagtcgtctgcatccaagtgattgtaatgaggcaagttcaacttgtttcggcacaatgggttgggtcaagcgacgtctcttgagtgtagaagcaaatcttgttagcgaaaagattatattgcatgcttctcaaaaaaaaaaaaaaaaaa

SEQ ID NO: 412 - DNA, 1863 bp, Trichophyton rubrum
ccccacgcccgactttcttctcctttcttcgacttcaacttctcaactccccaacttcacacaacaaacacaagagcaacagtcctcgaccccgacctcgaacacttcactccgtccactccaccctcaaccgcccgttactcccgtcaatatgcgtgaaatcgtccatctccaaaccggccaatgtggtaaccaaattggtgctgctttctggcaaaccattgctggtgagcacggtctcgatggatccggccactacaccggatcttctgacctccaattggagcgcatgaatgtctacttcaacgaggcctcaagcaaaaaatacgttccccgtgcggtgcttgttgatcttgagcccgccgctctcgatgctgtccgtgccggtcctttcggtcagctcttccgccccgataacgtcgtcttcggtcagtccggtgccggaaacaactgggccaagggtcactacactgagggtgccaacttggtcgaccaggtcatcgatgttgtccgtcgtgaggccgaaggctgcgactgcctccagggtttccagatcacccactccctcggtggtggtaccggtgctggtatgggtaccctcctgatctccaagatccgtgaagagttcccagccggtatgatggccactttctccgttgtcccatccccaatggtctctgacaccgttgtcgagccatacaacgccactctttccatccaccagctcgttgagcactccgacgagaccttctgtatcgacaacgaggccttgtataacatctgcatgagaaccctcaagctcactaacccatcctacggtgacctcaaccacctcgtctccgccgtcatgtccggtgtcagcaccagtcttcgtttcccaggtcagctcaactctgacctccgcaagttggccgtcaacatggttccattccctcgtctccacttcttcatggttggattcgctccccttactagccgcaacgcctactctttccgtgctgtctccgtgccggagttgacccagcagatgttcgatcccaagaacatgatggctgccactgacttccgcagcggccgctaccttacctgctctgccatcttccgtggtaaggtctccatgaaggaggttgaggaccaaatgcgcaacatccagaacaagaactctgcctacttcgttgaatggatccccaacaacgtccagaccgctctttgctctattcctccacgtggtctccagatgtcctctactttcgtcggtaactccacctccatccaggagctcttcaagcgtgtcggtgaccaattcactgctatgttccgtaagaaggctttcttgttctggtatactggtgagggtatggacgagatggagttcactgaggccgagaacaacatgaacgacttggtcagcgaataccagcagtaccaggatgcctccgtctccgacggtgaggaggaataccttgaggacgagcagcttgagggcgaagagtaaatgcaatgtgcaggtatatttctggctctcacgcctctctttcctcccacttgcatttcctttaagccatgcctctttctccgcacagcagatgtatcacatccactaagtgcaagccttgcgtccaatggactctagcgcgtgcttatgctcccaccctctgttctcttgtctgcttaataattccccaaccagcgtgttcgttttgaggcaagtcgatattagtcactgagtgattacaaaacatgatcaattggctgtttgatatcccctctacaacccaatattttttaattttgctcccttttcttttgtttttcggagaaacaatcataaaaacatttcccttttaaaaaaaaaaaaaaaaa

SEQ ID NO: 413 - DNA, 1471 bp, Erysiphe pisi
cgcggcctgggaatctaacacctgcgttcaacattctcccttctaagaatccataaccgtaattctctttaacataccgtccttaggctcgtatagttcaccatgcgcgagatcgttcacctccagactggccaatgcgggaaccaaattggagctgctttctggcaaaccatatctggagaacatggccttgacggatctggtgtatacaatggaacttccgacttacaacttgaaagaatgaatgtttatttcaatgaggcatccggaaataaatatgttcctcgagctgttctcgtcgacttagaacctggcactatggatgctgttcgagccggcccattcggtcagctctttagacccgacaattttgtattcggtcaatctggagctggtaacaactgggctaagggccattataccgagggtgcggagcttgtggatcaagtcttagatgttgtccgccgtgaagccgaagcttgtgattgtcttcagggttttcagataactcactcacttgggggtggaactggtgccggtatgggcacacttctgatatcgaaaattcgtgaagaattccctgatcgtatgatggctacattttcagttgttccatcaccaaaagtttcagatactgttgtggagccctacaacgcaaccctttcagttcatcaacttgtcgaaaactctgacgagactttctgtattgacaatgaagcactctatgaaatatgtatgagaactttaaagctctcgaatccatcttatggtgatcttaatcatttggtatctgccgtcatgtcaggtgtaaccacttgtcttcgtttcccaggtcaactcaactcagatcttagaaaattggcggttaacatggttccatttcctcgtcttcacttttttatggttggttttgctccacttaccagtcgcggtgcccactcattccgggctgtcactgtccccgagttaactcagcaaatgtacgatcccaaaaatatgatggctgcttcagacttccgaaacgggcgttatttgacatgctccgctatattccgtggtaaggtatcaatgaaggaagtggaggatcaaatgcgtaacgtacaaaataaaaactcagcatattttgtcgagtggattcccaataatgtgcaaactgcactttgctctattccacctcgtggtcttaagatgtcatctacatttgtaggaaactctacttccatccaagaactatttaagcgcgttggggatcaatttacagctatgttcaggagaaaagctttcttacattggtacactggagaaggaatggatgaaatggagtttactgaagctgagtcgaacatgaatgatttagtccacgaatatcaacaataccaagatgcctcgatttccgaaggtgaggaggaatacgaagaagagcagcaacttgaaaatgaggaatgagctgagattttgtcaaggtaggtag

SEQ ID NO: 414 - DNA, 1344 bp, Magnaporthe grisae 70-15; identical to SEQ ID NO: 39

SEQ ID NO: 415 - DNA, 1341 bp, Gibberella zeae PH-1
atgcgcgagattgttcaccttcagaccggtcagtgcggtaaccaaatcggtgctgctttctggcagaccatctctggcgagcacggtctcgacagcaatggtgtttacaacggcacctctgagctccagctcgagcgcatgagcgtttacttcaacgaggcctccggtaacaagtatgttccccgtgccgtcctcgtcgatctcgagcccggtaccatggacgccgtccgtgctggtcccttcggacagcttttccgacccgacaacttcgttttcggtcaatccggcgccggaaacaactgggccaagggtcattacaccgagggtgctgaacttgtcgaccaagttctcgatgtcgtccgccgtgaggccgagggctgtgactgcctccagggtttccaaatcacccactctcttggtggtggtaccggcgccggtatgggtaccctgttgatctccaagatccgtgaggaattccccgaccgtatgatggcaactttctccgtcgttccttcccccaaggtctccgacaccgttgtcgagccctacaacgccaccctctccgtccatcaattggtcgagaactccgacgaaactttttgtatcgacaatgaggccctctacgacatttgcatgcgcaccctcaagctgtccaacccctcttacggcgacctgaactaccttgtctctgccgtcatgtccggcgtcactacctgtctccgtttccccggtcagctgaactctgacctccgaaagctcgccgtcaacatggtgcccttcccccgtctgcacttcttcatggtcggattcgctcccttgaccagccgtggtgctcactctttccgcgctgtcagcgttcctgagctcacccagcagatgttcgaccccaagaacatgatggctgcctctgacttccgcaacggtcgttacctgacctgctctgccatcttccgtggccgtgtcgccatgaaggaggttgaggaccagatgcgcaacgtccagagcaagaactcatcatacttcgtcgagtggattcctaacaacatccagaccgctctctgcgctattccccctcgtggacttactatgtcttccacttttattggaaactccacctctatccaggagcttttcaagcgtgttggcgagcagtttactgctatgttccgacgcaaggctttcttgcattggtacactggtgagggtatggatgagatggagttcactgaggccgagtccaacatgaacgatcttgtctctgaataccagcagtaccaggatgctggaattgacgaggaagaagaggagtacgaggaggagctgcctgagggcgaggagtaa

SEQ ID NO: 416 - DNA, 1347 bp, Ustilago maydis
atgcgtgagattgtccaccttcagaccggtcagtgtggtaaccaggtcggtaccaagttctgggaagtgctctcggacgaacatggcatcgaccacaacggtaactacattggcaccagcgacgaccagctcgcccgcatcaatgtctactacaatgaggccagcggaaacaagtatgtgccgcgtgccgtgctcgtcgacttggagcccggtaccatggactctacccgttcgggtcctcttggtggacttttccgcccagacaactttgtgtttggtcagtcgggtgccggtaacaactgggccaagggtcactacaccgagggtgccgagcttgtcgactcggtgctcgatgtcatccgcaaggaggccgaaaactgtgacatgcttcaaggtttccagatcacccactcgctcggtggtggtacgggtgccggtatgggtacgctgctcatctccaagatccgcgaggagtacccggaccgaatgatggctaccttctcggttctgccttcgcccaaggtgtcggacacggttgtggaaccttacaacgctacgctctcggtgcaccagctggtcgagaactcggacgagaccttctgtatcgacaacgaggcgctgtacaacatctgcttcaagacgctcaagctcaacgcccccacgtacggtgacctgaaccacctggtgtcgctcgtcatgtctggtgtgacgacttgcctgcgtttccccggtcagctcaactcggacttgcgcaagctggctgtcaacatggttcccttccctcgtctgcacttcttcatggttggtttctcacctctgaccgcgcgtggctcgcagtcgtaccgtgctgtgacgatccccgagatcacgcagcaggcgtttgacagcaagaacatgatgacggcttgcgacactcgtcttgggcgctacctcacgtgcgccgcgtacttccgtggtaaggtttccatgaaggacgtcgaggatcagatgcagagcttccagcagaagcactcgacgcagtttgtcgagtggatccccaacaatgtgcagacggcacagtgtgacattcctcctcgtggcctcaagatgtcggtcacgtttatcggcaactcgactgcgatccaggatgtgttcaagcgtatcgccgagcaattctcggccatgtttaagcgcaaggcgttcttgcactggtacacgggtgagggtatggacgagatggagttcaccgaggccgagtccaacttgcaagacttgatcgccgagtaccaacagtaccaggatgcctctgctctggacgaggacattgagggcgagtacattgaggaggaggagcttgttcaggagtaa

SEQ ID NO: 417 - DNA, 1344 bp, Aspergillus nidulans FGSC A4
atgcgtgagatcgttcaccttcagaccggccagtgtggtaaccaaattggtgctgctttctggcagaccatctccggtgagcacggcctcgatggctccggtgtttacaatggtacctccgaccttcaactcgagcgtatgaacgtctacttcaatgaggccagcggtaacaagtacgttccccgtgccgtcctcgtcgatctcgagcccggtactatggatgccgtccgcgccggtcccttcggcgagctcttccgtcccgacaacttcgttttcggccagtccggtgctggtaacaactgggccaagggtcactacactgagggtgctgagcttgttgacaacgtcgtcgatgttgtccgtcgtgaggccgagggttgcgactgcctccagggtttccagatcacccactctctcggtggtggtaccggtgccggtatgggtactcttttgatctccaagattcgtgaggagttccccgaccgcatgatggccaccttctccgtcgttccctctcccaaggtctccgacaccgttgttgagccttacaacgccaccctttccgttcaccagctcgttgagcactccgatgagactttctgtattgacaacgaggctctctacgatatctgcatgcgcaccctcaagctctccaacccctcctacggtgatctgaaccacctcgtctccgccgtcatgtccggtgtcaccacttgccttcgattccctggtcagctgaactctgacctgcgcaagctggctgtcaacatggttcccttccctcgtctgcacttcttcatggtcggcttcgctcctctgaccagccgtggcgcctactccttccgcgctgtttccgttcccgagttgacccagcagatgttcgaccccaagaacatgatggctgcctctgacttccgcaacggccgctacctcacctgctccgctatcttccgtggaaaggtctccatgaaggaggttgaggaccagatgcgcaacatccagagcaagaaccagtcctacttcgtcgagtggattcccaacaacatccagaccgctctctgctccattcctccccgcggcctcaagatgtcttccaccttcattggaaactctacttccatccaggagctcttcaagcgtgtcggtgaccagttcactgctatgttccgtcgcaaggctttcttgcattggtacactggtgagggtatggacgagatggagttcactgaggctgagagcaacatgaacgatctcgtctccgagtaccagcagtaccaggacgcctccatctccgaaggcgaggaggagtacgccgaggaggagatcatggagggtgaggaataa

SEQ ID NO: 418 - DNA, 1359 bp, Candida glabrata
atgagagagattatccatatatctactggtcagtgtggtaaccagattggtgccgcattttgggaaactatctgtggtgaacatggcctggactataacggtaactaccatggaactgaggaaatccaaagatcgcgtctaggcgtttacttcaacgaggcctctagtggtaagtgggtcccaagatctatcaatgtcgatttggaaccaggtactatcgatgccgtgcgtacttctaacattggtaacttgtttagacctgacaactacatcttcggccaatcctctgctggtaacgtttgggctaaaggtcactacacagaaggtgccgaattggttgactcggtgatggacgtcattagacgtgaagccgaaggttgtgactctttgcaaggtttccagatcacacactccttgggtggtggtaccggttcaggtatgggtaccttactgatatctagaatcagagaagaatttcctgatagaatgatggcaacattctcagtcttgccatctccaaagacttctgacactgttgtcgaaccatataacgccactctgtctgttcaccaattagtcgagtactcagatgaaactttctgtatcgataacgaggctctatacgaaatttgccaaacaactttgaagttgaatcaaccatcttacaatgacctaaataatcttgtgtcaagtgttatgtctggtgttaccacctctctacgttacccaggtcaattgaactccgatctgaggaaactggccgtcaacttggttcctttcccaagactgcatttcttcatggttggctatgcaccactaacagccattggctcccagtcctttagatcattgactgtgcctgagctaacccaacaaatgttcgactcaaagaatatgatggctgctgctgacccaagaaatggtagatatctaaccgtggcagctttcttcagaggtaaagtttctgtcaaggaggtcgaagatgagatgcacaaggttcaaactaagaactcttcatattttgtcgagtggattccaaacaatgtacaaaccgctgtttgttctgttcctccaaaagatttggacatgtctgccacatttattggtaactctacctctatccaagaactatttaaaagagttggtaaccaattcaatgccatgtttaacagaaaggcgtttttacactggtatactagcgagggtatggatgaaatggaattcacagaggctcaagctaatatgaccgacttagtaaatgaatatcaacaataccaagaagctactgtggaggaagaaatagaggaaggtgctgagtacataacggaagaacagccaatgcctgaaacttttgattaa

SEQ ID NO: 419 - DNA, 1694 bp, Cryptococcus neoformans var.
ctcttttctcgcgaccacgcgtcccaacagtcgacaacccaccttctttccttccttccctacttctctagcccccatcaaagatgcgagagatcgttcaccttcaaaccggtcagtgtggtaaccagatcggtgccaaattctgggaggtcgtctccgaagagcacggcatccaggccgatggctcttacaagggtaccaccgacacccagctcgagcgcatcaacgtctactacaacgaggccgcggcgggcaagtatgttcctcgagccgtcctcattgatctcgagcccggaactatggactccatccggggtggccctcttggtagccttttcaggcccgataactttgttttcggccagtcgggtgccggtaacaactgggctaagggccactacactgaaggtgccgagcttgttgactctgtcctcgatgttgtccgacgagaggccgagggctgtgactgccttcaaggtttccagatcacccactctctcggtggtggtaccggtgccggtatgggtacacttttgatctctaagatccgagaagaattccccgaccgaatgatgtgcactttctccgtcgttccctctcccaaggtctcggacaccgtcgttgagccttacaacgccactctttccgtccatcagctcgtcgagaactctgacgagacgttctgtattgacaatgaggccctctatgacatctgcttgcgtactctcaagctttccacccctacatatggtgacttgaaccacctcgtctccgttgttatgtctggtgtcactacatgtcttcgtttccccggtcagcttaactccgaccttcgaaaattggccgttaacatggtgcctttccctcgtcttcatttcttcatggtcggctttgcgcctctcaccgcccgaggctccgctagctaccgtgccgtcaccgttcctgagcttactcagcaaatgtttgacgccaagaacatgatggctgcctctgaccctcgccatggccgatatctcactgtcgcctgctactatcgaggcaaggtttccatgaaggaggttgaagaccagattcagtctgtccaggccaagaactccgcttactttgttgagtggattcccggaaacatctctgccgcgcagtgtgacatccctcctcgcggtctcaagatgtcctctaccttcatttgcaactcgacttccatccagtcgcttttcaagcgtatcggcgagcagttctctgccatgtacaggcgaaaggctttcgtgcactggtacactggagagggtatggacgagcttgaattctctgaagccgaatccaacttgcaagacttggtatccgagtacatgcagtaccaggaggcgggagcggacgacgaaatctatggtgatgaggagatccccattgaggaggaggagatgtaaggtctcctcgtccctatgttgccccttctaccccacatttaccctttgcatccgtgcttcgcaccccaccaccacagcgactataaggtcgttgggttttgctaaaggtttatcttattccccgcatctatatatccccccctttcctttttgcctcacccggaggttgagttctccgatgtctcgctgatgagacggtgtgctgcatacttcgacattcttttcagtgattggtctctacagttctatgcaacttgtgaggcctgg

SEQ ID NO: 420 - DNA, 1401 bp, Aspergillus fumigatus
atgcgtgaaatcgttcaccttcagaccggtcagtgtggtaaccaaattggtgccgctttctggcagaccatctctggtgagcatggccttgacggctctggccacggcggaaacacggaaaacaaggaagaagcggacgcgtgtctgatgggaaataatagctacaatggctcctccgatctccagctggagcgtatgaacgtctatttcaacgaggccaacggtgacaaatatgttcctcgtgccgttctggtcgatctcgagcctggtaccatggacgctgtccgtgccggtcccttcggcgagctattccgtcccgacaacttcgtcttcggccagtccggtgctggtaacaactgggccaagggtcactacaccgagggcgccgagttggtcgaccaggttatcgatgtcgtccgtcgtgaggctgaaggctgtgactgcctccagggcttccaggtcacccactctctcggtggtggtaccggtgccggtatgggtactcttctgatctccaagatccgtgaggagttccccgaccgtatgatggcgaccttctccgttgttccctcccccaaggtttccgacactgtcgttgagccttacaacgctaccctctccgttcaccagctcgttgagcactccgatgagaccttctgtatcgacaacgaggctctgtacgacatttgcatgcgcacccttaagctctctaacccctcttacggtgacctgaaccacctggtctccgccgtcatgtccggcgtcaccacttgccttcgtttccctggtcagctcaactctgatctgcgcaagttggccgtcaacatggttcccttccctcgtctgcacttcttcatggtcggcttcgctcctctgaccagccgcggtgctcactctttccgtgctgtctccgttcctgagttgacccagcagatgttcgaccccaagaacatgatggctgcttccgacttccgcaatggacgttacctcacctgctctgccattttccgtggtaaggtttcaatgaaggaggtcgaggaccagatgcgcaacatccagtccaagaaccagagctacttcgttgagtggattcccaacaacatccagaccgctctgtgctccattcccccccgtggcctcaagatgtcctcgaccttcattggtaactccacctccattcaggagttgttcaagcgtgtcggtgatcagttcactgctatgttccgtcgcaaggctttcttgcattggtacactggcgagggtatggacgagatggagttcactgaggccgagagcaacatgaacgatctggtctccgaataccagcagtaccaggacgcctccatctctgagggtgaggaggagtacggcgaggaggagcccctcgaggctgaggagtaa

SEQ ID NO: 421 - DNA, 1674 bp, Magnaporthe grisae 70-15; identical to SEQ ID NO: 3

SEQ ID NO: 422 - DNA, 1656 bp, Gibberella zeae PH-1
atgacagacagcacaaagcccaagggcaagaagcctgataaggacggtgacgaggagatgactgttgttgttcctccttccaagtcgagaaagtctgacaaggcaaccgccgataccgaaggcgacgtgtcaatggaagaggaagaggaggaggtcaaggtcgaccctgtggtacagactatcgcagatatcaagagcaactttgccctgatagaccgtgccgtggcccacttcgacgccagattctccctccgcgccctgcgttctatctctattatccgcaagcgtttgacacccgatattattgcccaggtcatctccgacgctttccctgccaccgccaactcgagtgctattgtcaagccactgctagctgccattgagcgcgaggatgtcacccttggtcgacagagtggttcagagatggacatcgacgatgccaagacatctggaaagaacgtttccaagaaggaggctaaggacctcattcctgagatcgatatcttcctcggcatcctcgtccaggtgtaccttttcgactcaaagcagttccagcgtggagccgacttctctaagtacctttcggacagagtgcagtctctcaaccgccgcaccctggactctttgtccgctaaggtctacttctactactcaatcttctgcgagcagatcgcccctctccctccgtctccccagtctcctgtggtcgcgattcgaccaactctcctcgccgctcttcgaaccgctgtgctacgcaaggatgtcgacacacaagcctcagtcattgttctgttgctgcgaaactatctctcaacttcgcacattaaccaggctgatctcctggtctctcacacccagttccccgagaacgccgtcaacaaccaggtagcacgattcctttactaccttggtcgtatccgtgctgtccagctgcgatacactgaggcccatgagcatctcactgctgccacccgaaaggctccatctagtagctgtgccctcggcttcgcccagacagcaaccaaacttctttacgtcgtggagctgttgatgggtgacattcctgaccgagccatgttccgccagccaacaatggaggctgctctccagccttacttcttgctggtcaagtcagtcagggttggcaacctcgaggactttgagacagcgattgccgaccatgccgataccttccgacgagatggcacatacagccttatcttgcgtctacgacaaaacgttatcaagactggtatccgtatgatgtctttgtcttactctcgtatctctcttcgggatatttgtatccgtctccagcttggtagtgaggagtcggcagagtacattgtcgccaaagccattcgcgatggtgtgatcgaggctactctggaccgcgagaggggcttcatgaagagcaaggaggttggtgatgtgtatgctactcgtgagcctggtgaggctttccacgaccgaattcgagcttgtctagcgctccacgatgagagtgtcaaggccatgcgattccccatgaaccaacatcgtcttgagcttaagaacgcccaggaggcccgggagcgcgagcgtgagatggccaaggaaatacaggagggtgacctggacgaggatgacctcggcggagagtatgatggcatctaa

SEQ ID NO: 423 - DNA, 3279 bp, Aspergillus nidulans FGSC A4
atgccagctgagaggcgctctttgagatccaacaacaagtcagatacttcttcgcccgctaacggtgaaaagactcgttctggttcgcagagttcgagctccaataaagataagccgactactcgcactgctgccagcaaggccaagtccacgaaggtcgcctctacgaataccgcttcagactccggtatgggagaacaacgggaccagccgcataccaacggctcagatccgactaagaatggcgtgaatgggtctgaagatatcgagatggacgaggatacggcaggtgggcctacatcctcattcaacgccagcaaggaccggaaaggtgaccagaaaatgactgttgtagtgcctcccaccaagggtcctagggtaaccggcgagaaaagccaggagcaggagggcgacgtatcgatggaaggtgccgaggacgagaagcctgggtcagaaattgatcccaaggtgaaggccattcaagacatcaagacgaactttattttcctcgaacgtgcggtcacccattttgaccccaggtttacgctccgcgtcttgaggtcgatatctgcaatgcgcaaacaaatcacgtcagatgtgcttgcagaagccattgttgccgcttacccaacttcaagtgcgactgcctctttcttgttggatgcgattgatcagccaggtgcttctgaaaacgtcgggtcaagctcgaatatggaagtagaaaatgacaagacgaagccctcttcaaaagaggttctccccgagattgacatctacttgtctatcctagtccagatctatctgtacgatcggaaggaaattcagaagggcgccaaattctcgacccgcttgatcgaaaggcttcgagcgctcaaccgccgcacgttggactcccttgccgcacgtgtgtacttctattattcgcttttcttcgagcagattgctcctcttcccccgtctcctgctgcggcgattacctccattcgtcagccactacttgcagctcttcgaacggccgtcctacgaaaggatgtggatactcaagctaccgtgatgaccctcctcctccgtaattacctttctacttctcatatctcacaagcggacttgctgatttcgcacaaccaattccctccgtcggcgtcaaacaatcagattgctcgctacctgtattacttgggccgcatccgagctattcagttgcagtataccgaggctcatggccatctgatcggcgctacccgaaagtctcctgcaagccacagtgcgcgtgggttctatcaagcttctcacaagctgcttgtggtcgttgagctactcatgggagatattcctgaccgtgcgattttccgccaggcggctcttgagcgggctctacatccctatttcttgctggttcaagccgtgagtgtcggtgatctggatggcttcttgaacattgtaaatacgcacagttcaacattccgaaaggacggcacgtacactctcatcttacgcctacgacagaacgtgattaagaccgggattcgcatgatgtccctttcttattcgcgcatttcccttagggatatctgccttcgtctgggtctggatagtgaagagtcggccgaatacattgttgcgaaggcaatccgcgacggtgtcattgaagcaagcttggaccatgagcgaggattcatgaagagcaaggatgttggagatgtatacgctaccagggagcctggcgaagttttccatgaacgtattagggcatgcttgggcctacatgacgagagcgttaaggcgatgagatttccgatgaaccagcatcgcctcgagctgaaaagcgcgcaggaggcgagagaacgtgagagagaactcgccaaggagatccaagaaggcgacatagatgatgaagatgctgtcccagctggcaagctggtactcgcatcaccggtcacaccccagacacctatatgctggcaatgcctccgcaatgatctctccctaggtcaatccaaattccaaaaccgcaaatatcacccctctcgtcgaaaagatgcttccccctttggcgcggcggtttcagcagcccaaacgctcttcaagggtctacccaaagcgcctcctgggatatcagtcgatccgttgaggatcgtgggcaaggaactcaaatttctcaccaaaaatatccgtcagcttcttggttcgggacatcctacgctggataaagtggcgaaatactatactcgaagtgagggcaaacatatgcgaccactgctggtgttgcttatgtcccaagcgacggcattgaccaccccaagatccaatcgctccacgtcggatgcagctctaagttctgtgacggtcaatgaccctattacttctccttctgtccttgccgacaccaacccagacctggatcggctcacgtcacagtcgccaacagaaggtcagtacgactttgctggcgatgagaacatcctcccttcccagcgacgacttgctgaaatcaccgaattgattcacactgcttcactcctccatgatgatgttattgataacgccctcacccgtcgctcctccaactccgcgaacatcgaattcgggaacaaaatggctgttttggcaggtgacttcctgctcggtcgtgcctccgttgctctggcccgcctacgagaccccgaggttacagaactcttggctacggtgatcgccaatctcgtggagggagagtttatgcagctcaaaaacactgccgaggacgaaaagaaccccgtttttacagacgacactatctcatactacctgcaaaaaacctacctgaagaccgcaagcctaatcagcaagtcgtgccgcgcagctgcactacttggccatagcactcctgacgtggtcgaggccgcgtattcctacggccgcaatttgggactagcgttccagcttgtggacgacatgcttgactacacagtcagcggtgttgaactaggaaagcctgccggggcggacctagaactcggccttgcaactgctcctcttcttttcgcctggaaacaacacccggaacttggccccttggtcggtcgtaaattttgccgggagggagacgttgaaaaagcccgagaacttgtctaccgcgccaatggtgttgaacaaacccgtgctctagctcaagaatatgcagacaaagcaattgctgccatcagcccgtttcctgatagcgaagcaaaggccggtctgattgagatgtgcagaaagaccatgaatcggaggaagaggacaacaagggatagcacatga

SEQ ID NO: 424 - DNA, 1917 bp, Aspergillus fumigatus
atgccggctgagagacgttcgttgcgatcgaacagcaagtcagatacttcttcatctgctaacggtgaaaaagcgcgttccaactcgcagagctcaagttccaacaaggacaaggccgcgccaaaccgtgccgctgccaacaaggccaaatctcccacaccggcggcttcgtccaataacgtatctaactccggtatgggcgagcagcgtgatcagccgcataccaacggcgtgaacggttctgaagatattgagatgggagaggatacggcaggtgggcctacatcctcattcaacacccgtaaggatcggaaaggtgacgagaagatgactgttgtagtgcccccgtccaagggttcgaggttatccggagagaaagggcaggaccgggaggaagatgttgtcatggaggccgcagagactgattcccaaaagcccgagtcggaggttgatcccagagtcaaggccattcaagatatcaagaccaacttcacacttctcgagcgagctgtagcccacttcgaccccagatttacactgcgcgttctcaggtcgatatcctcaatgcgcaagcacatcactgccgatgtgctggcagaagtaatcgttgagacctatccaccctcaagtgctactgcttttttcttactggaagctattgatcaatctggcgcatacgagagcgccattgctagttcgaagatggaggtcgattctgacaagaacaagtctgctcccaaagaaatactgccagaggttgatacctatctatccatcctcgttcagatctacctctacgacaagaaggatattcaagggggcgcaaagttctcgacagcgttgactgagcgtctgcggactcttaatcgtcgcacgctagactctcttgctgctcgcgtatacttttactactccctcttcttcgagcaggttgctcctcatcctccatctcctgctgcggcggttacctccatccgccagcccttgcttgctgcccttcggacagccgttctccggaaagatgtcgatactcaggccaccgtgatgacccttcttctgcgaaattacttgtctacatcccacatcccgcaggcagacttgctcatctctcacaaccgctttccgccttctgcatcaaacaaccagattgctcggtacctgtattatctgggccggattcgtgcgattcagctgcaatatacggatgcccacgggcacctgattggtgccactcgcaagtctccttcgagtcacagtgctcgtggtttctaccaggcttctcacaagctgctcgtagttgttgagcttttgatgggcgatatccccgatcgtgcaatcttccgccagcctgcacttgagcgcgctttgcacccttacttcttgctcgtccaagcggtgagcgttggagatttggatggcttcttgaacattgtaaatacgcacagtgcaacgttccggaaagatggtacctacaccctgatcctgcgtttgaggcaaaatgtcatcaaaacgggtatccggatgatgtcattgtcctactctcgcatctcgcttcgggacatttgcctgcgtttgggcctggacagtgaggagtcggcagaatacatcgtcgccaaagcaatccgcgatggtgtgattgaggccaccttggatcatgagcatggatacatgaagagcaaggaagtcggagatatctatgccactcgcgagcctggagaggtgttccacgaacgtattcgggcttgcttggctctgcatgatgaaagcgtcaaggccatgagatttcccatgaatcagcatcgcctcgagctcaagagcgcacaggaggctcgggaacgggaacgagagctcgccaaagagattcaggagggggatattgatgacgaagacgctggcggtgattttgacgccatctag

SEQ ID NO: 425 - DNA, 1893 bp, Magnaporthe grisae 70-15; identical to SEQ ID NO: 37

SEQ ID NO: 426 - DNA, 1899 bp, Gibberella zeae PH-1
atgtcagtcggactcgctggcggcgcacatactgccttggacgaagaggcaagggccgaggttgatgtcctcaactcgcgactagagaagacaacgcaattgaccaagaagattcaatcttgtcttaatcgactcgagacaacaggaaagagtgtccaggatgttgcggggcctctgaatggagagactaggcgactgcaaatactgggaaacaatgtcgactctgtccttgctgcgatcgatcgcttgcgccagcctgcagatagcaagaatgacgaggaacaaataatccgggtcggtcctgagaaggctggtctatctacctacctggcctctataaagcgtctaggcaaagccttggctgagatgcaggcatcgaatctgcgtgcgaaccagcaaaccatggccgacttgtcacgtctcatcaaatcgggcaacagtcagcttgaacatcacttcgaaactgtgcttcgcggcgagacaccccgatctgtcgagccactgcactacatcacgaaagacaagccctttccaacacttcctcaagacaagatcgcccgtcttggtcttatctattcctatgttgtcgagagccatcacaatggcgcctcagagcttgctcacatatacgcagaagtacgcggtccgtacctctcagcatctctggccaaccttgccgcagcaagtgtcaatactgctaagaagaagagcccggatgctgtttaccgggcgggtaccaacggcatggggacttatgcacaagcgatggaaggcttgttcatatccgagtacgacaacgtctgtagcgttttctctcgcgaggattggggtgttatcttcctatcgacttgccaaacagctttagcagaacaggcacgatgcctgcgcgagctaaatgctcacatcaagagccacctcaacacagactgctacttggcttacgagatcaccgaaataatctctgcgctttctggaaagctcgaaacacgaaccggcgaattaaagggagcacttgccgctgcattgaaacctgttagagagactgcaaaatcgtctctggcagaactcctagaagaaacaaggcgcaaggttgggatgttacagatactcccttccgatggtgcaccaatacccttggtatcggagacaatgcaacgccttcagaccatggtgcatttcctgcgcccaatctcgagcatcatgatatccattggggatggtggttggaaggcaaatgcagcaacaaatgggcgctcaacagacgctattcccagcctagcatcctttgatattggagcagacggcaaagagatattctcacattattgtctcgacaccattgagatgcttctgtccgggctggaccagaaatcacgcgtactcatgaagagcagagctgttgctggagtattcatggccaacagcgttgtcattatcgggcgaatggttcaaacgtcagaactaaatgatctcctagaaaacaaacttgatattcttgagcagtggcgtaagaaggcaacggcatcctacacagatatttgcaaggacctttctgtacaccttttcgatactgttcatactaatcgaaccaatcgacctacgtccgggcctgtcgactcgacatccatcgtcaaggggctgggcagtaaagacaaggataagatcaaggagaagttcacacagttcaatggcgcatttgatgatatggtgtcccgccacaaatcttacagtatggagcgtgaagtccggcgaatatttggagaagatattcgtcagaaactacagcctctctacgaacgattttgggaccgataccacgagatcgacaagggcaaaggcaagtatgtcaaatatgataagacatccattgctgcagtttttgctagcctggcatcatga

SEQ ID NO: 427 - DNA, 1611 bp, Magnaporthe grisae 70-15; identical to SEQ ID NO: 9

SEQ ID NO: 428 - DNA, 2631 bp, Magnaporthe grisae 70-15
atggcgacgtcagacatcacgacggtgctcacaaattcgctgtctgccgatgcgaacctgcgacatgccgccgaacagcagctcacacaggcggctgagaccaacttttcattataccttgcgactcttgttaccgagctagcaaatgagaatgccccgggtcacattcgagctgccgctggtattgcggtgaagaacgcgttcacagcccgcgagttcagccgtcaaactgaactgcaacaaaaatggcttcaacaaacagacgacgaaaccagggcaaaggtcaagagtctcactctacagaccttgtcgtcaaccaactcccaggctggccaggccgccgcccaggtcatcgcctccatcgctggaatcgagcttccccgtggacaatgggccgacttgatgaacatcctcgtcacaaatgtcagcgagggtcaaccccaccagaagcaggcatctctgactacgataggattcatctgcgagagtcaagatcctgagctccgcgctagcttggtcgaccactccaacgctatcctgacggccgtcgtccagggtgctaggaaggaggagaccaacaatgagatcaggctggccgccatcactgccctcggagactcgctcgagttcgtcggtaacaacttcaagcacgagggcgagcgcaactacatcatgcaagttgtctgcgaggccacacagggcgacgactcacgcatccagcagggtgcctttggttgcctgaaccgtatcatggccctttactacgaaaacatgcgtttctatatggagaaggcgcttttcggcttgaccattttgggcatgaagagcgaagacgaggacgttgccaagctggctgttgagttctggagcaccgtttgtgaagaggagattgccatcgaggacgacaacgcacaggtcgagagcgcggatcaggtcaggccgttttacaacttcgcccgcgtggcaaccaacgaggtggtccccgtcctcctcacccttctcaccaagcaagatgaggacgccgccgacgacgagtacaacatttctcgtgctggctaccagtgtctgcaactttacgcccaggctgttggtggcaccattatcccgcctgttatctcctttgttgagggcaacctccgatccgatgactggcacaacagggatgcggctgtctctgcttttggtgccattatggagggtcccgacgagaagactctggagccgattgtcaagtccgctctgcaaattctcatctcaatgatggacgactcctcggtacacgtcaaggactcgaccgcttacgctcttggtcgcatcaccgaggcctgctccgaggctattgaccccagccagcacctcgagcctctgatccgctcgttgtttgctggcctgctaaacactcccaagatggccgcctcgtgctgttgggctctgatgaacctggcggaacgttttgccggtgagcccggagcgccccagaatgccatcactgcctacttcaacgacagtgtgcgcagcctcctggacgtcaccgccaagaacgattgcgactcggctgtcaggacggccgcgtatgaggttctcaacgctttcatcgtcaatgcggcaaacgatagtctgcaggctgttgccactctttcggatgttatcatcaagcgcctagaggagacgataccactacagacccaggttgtcagcgtcgaggaccgtattacactcgaggacatgcagaccagtctgtcgactgttcttcaggccatcatcggccgtcttgacaaggaaatccttcctcagggcgaccgaatcatgcaggtgctgctgcagattctgtcaacggtcaacggcaagtccactgttcccgaggctattttcgccaccatcagtagccttgccaatgctatcgaggaagagtttgtcaagtacatggatgcctttgcgccgttcctctacaatgctctgggtaaccaggaagaacccagcctgtgctccatggctatcggcctcgtgagcgacattacaaggtcaatgggcgaacgcagccaaccgtactgtgacaactttatgaactatctccttaacaacctgaggagctcaacactttccaaccaattcaagcctgccattctgcagtgcttcggggacattgccaacgccattggcggccactttgagacttatctgtctgttgtggctcaagttttgcaacaagcctccactgttaccacagtacccgagggctcatatgagatgttcgactacgtcgtctcattgagggagggtattatggacgcctggggcggcattattggtgccatgaagagcgccaacaagacccaagccctccagccttatgtcccatccattttcgagctgctgaaccacattggtagcgactcgaaccgtagcgagtctctgatgcgcagttccatgggtgttattggcgatcttgccgatgcctaccccaacggggagctcgtggatgctttccgtcaggactgggttactgctattatcaaggagacgcgttccaaccgcgagttttcatcgcggacaatcgagacggcacgctgggcacgtgagcaggtcaagcgtcaacttgggggttccgtcaatgtcatgcagcagacttga

SEQ ID NO: 429 - DNA, 2634 bp, Gibberella zeae PH-1
atgtcgagctcagagataaaccaggtgctcgcaaattcgctttcgcctgatgcgaacctgcgaaatgctgccgagcagcaactcacccaagctgccgagagcaactttcccctatacctcgcaaccctcgtacaagagctagcaaacgactccgccgatggctctatccgagccgccgccggtatcgccctcaagaacgccttcacaacccgagattttgctcgccaccaagaattgcaagcaaagtggttgcagcaaacagatgatgagaccaagaaccgagtcaaggagctcaccctccagaccttgagctcctccaacacccaggccggtactgctgccgcccaggtcatttcttctatcgcagccatcgagttgccccgtgaccagtggaacgatctgctaccattcctcgtcaagaatgtcagcgaaggtgccgaccaccagaagcaggcttctttgaccactatcggctacatctgcgaaagccaagactcagaactgcgtatggccttggtaacacactcgaacgctatcttgaccgctgtcgtccagggagcccgaaaggaggaaactaacattgaggtccgactggctgctattaccgctctcggcgactcactcgaattcgtcggcaacaacttcaagcatgagggcgagcgtaactacatcatgcaggtcgtctgcgaggccacacaggccgacgactcaaggatacagcagggcgcctttggctgcctgaaccgaatcatggccctctactacgagaatatgcgattctacatggagaaggccttgttcggcctcacaattcttggcatgaagtctgatgacgaggatgtcgccaagttggccgtcgagttctggagcactgtttgcgaagaggagatctctatcgaggacgataacgcccaggtcgagagttcggatcaaatgcgtcccttctacaactttgcccgcgtcgctgccaacgaggtcgtaccagttcttctgcttctcctcaccaagcaggatgaggacgccaccgacgacgagtacaacctgtctcgcgccgcctaccagtgcctgcagctgtacgcccaggccgttggtgctaccatcatcagccctgtgctgtcatttgtcgagagtaacctgcgccacgaggactggcacaaccgagatgccgctgtttccgcctttggcgctatcatggaaggccccgacgagaaggtcctggaccctatcgtaaagcaggcactgcctatcctgatcaccatgatggaggaccagtctctgcacgtcaaggattcaactgcctacgctcttggcagagtcacagatgcctgctccgaggccattgacccccaggctcaattgcccaccctgattgagtccctcttcaagggtctcctcagcagtgccaagatggcaccatcatgctgctgggccctgatgaacttggccgagcgtttcgccggcgatttcggcgctgcttccaacgctatcacccctcacttcaacaatgctgtcagctctttgcttgacgtgactgcccgtcaagatgccgagacatcagtgcgaactgcttcttacgaggttctcaacgtttttgtccagaacgccgcttccgagagtctgcaacctattgcttctctctctgacgttatcatcaagcgacttgaagagaccgtgcctctacagagccaggttgttagcgttgaggacaagatgaccctcgaggagatgcaaaacagtctgtgcagtgttctccaggctatcatctctcgactcgacaaggagatcattccccagggcgatcgcatcatgcagatcctgctctcaatcctcaacagtgttggtggaaagtccagtgttcctgatgccgtcttcgctaccatcagcgccctttccactgctatggaggaggacttcgtcaagtacatggacgcctttgcccccttcttgtacaatgctctcggaaaccaggaagagcccagtctctgctccatggctattggcctggtcagcgatatcactcgatccctcggtgagcgcagccaaccttactgcgacaacttcatgaactacctcctcaacaacctgaggtcacagagcaccgcccttgccaaccaattcaagcccgccatcctccaatgcttcggtgacatcgctggcgctattggtggtcacttcgagacctacctgtccgtggttgcccaggttctggaacaagcctccactgtcactgcttctcccgagggcccctatgaaatgtttgactacgtggtctctctccgtgagggtattatggatgcctggggtggtattattggcgccatgaaggtcagccagaagacccaagccctccaacaatatgtgcctgtcatcttcaacgtcctcaacctcattgccaatgatatgaaccgaagtgaatcgttgatgcgagcttccatgggcgttattggcgaccttgcggatgcttaccccaacggtgaactggttgacgctttccgtcaagattgggtcactgctatgatcaaggagaccaagaccaaccgagagttccagccacgtaccatcgagacagcccgctgggcccgcgaacaggtcaagcgccagcttggtggttcccaggctgtcatggccaactag

SEQ ID NO: 430 - DNA, 2637 bp, Ustilago maydis
atggacgcaaatcagctcttgacaaatacgctctcgccggatcaggctattcgtactgatgccgaacagaagctcgaggccgccgctcgcgacagctatcccgtctacatgagcacgctcgctgccgagctggccaacgaatcgtctccctcgcatatccgaactgccgctggccttgcggtcaagaatgcactcaccgcgcgtgatcaatcgcgcgtcgaagaatacaccgccagatggactctcttaccccaaggcagccgcgatgatatcaagcaaaaagttcttagcaccttgggcagccaagagcatcgtgcaggtaccgccgcagctcaggtggttgcagcgatcgccgccatcgaactgcctgtaggcctgtggaacgagctcatctcacaactcttgagcgccatgggtgatgccaacaacatgcgtttgcgacaggccgctcttcaggctatcggtttcacatgcgaaggcatcagctccgacgtcttggcagcacagtccaatgagatcctcactgccgtcatccagggcgcacgtaaggaagagccagcgcccgaggttcagcttgctgcgcttcaggcgcttttcaactcgctcgagtttgtccgtgccaacttcgagcgtgagggcgagcgtaactacatcatgcaggtcgtctgcgaagctacacagagccccaacatgccggtcaaggtggctgcctacgagtgtctggtcagaatcatgcagctttactacgacaagatgcgcttctacatggaacaggctctcttcggtctcactgtcctcggtatgcgcgactcggaacccaaggtggcgctgcaagccgtcgaattctggtctactgtctgtgacgaagagatcgagctggcgctcgaagccgaagaggctgccgaatttggcgaggagcccgaacgtgtctgctacaactttgctcgcatcgcattgcccgatatcgtacctgtgctgctcgagctgctcaagacccaggacgaggatgcggacgaggacgaatgggacgtttcaaaagctgctggtacctgcgtcggtcttcttgctcaggtcgttggggacgacatcgtgcgccttgctgtgccctttgtcgaaggcaacatcaagaatcccgattggcatgcgcgtgaagccgccgtcatgtgctttggctccatcatggaaggtcccgaccgcaagacgcttgctcctctggtagaatcagcgcttccgatcatcatcgagatgctccgcgaccagagcatcgctgtcaaggacacggctgcttggaccctcgggcgcatctcggacctctgctgcgattcgattaagaccgacgtgcatcttccggcgctcgttcaggcactcgtgcttggactgcaagatgagccccgcatcgtcaccaactgctgctgggctatcatgaacctttccgagcagcttggtaccaatgctgcggcgtacgataacgcaggcgaacctacggatgccagcgctgtaccgaccacgcccctgtcgcccttcttcgagggcatcgtctccagccttctgcaggccaccggacgcagctccaacgaatccaacagccgcacgtccgcttacgaagccttggccagctccatcacccactgcgctgccgactgtattcaacaggctagcggcgtcttggtgcagatccttgaccgacagcagcagctcaatgaggtagccggtcagctcgtcggtgtggacgatcgcaacaactgggctgagcttcagggcaacctgtgcagcgtcttgatggcctgtgtgcgccgtctcggtcgcgagacgcttccattgggcgatcgcatcatgaccaatctcctgacgctcatccagaacggcagcaagcagccaaccgtgcttgaagacgctttcttcaccgtcggtgccgttattgccgctttcgaagccgactttgaaaagtatctcggcgccttcctgcccttcatggtcgaaggcctgcgcaaccacgaagagtaccagctgtgctcgatcagcgtcggtctcatcggcgatatctgtcgtgctctgggcgaaaactcggcaaagtactgcgacgactttatgaacgcgctctttgctaacctccagtcgcctcagcttaaccgcagcgtcaagccgcccattctctcgtgcttcggtgacattgctatggcgatcggcgccgcattcgaaaagtatttgcagatgggcatgtcggtgctgcagcaggcttcgctcatccagaccgtggaccctaacgactacgacatgattgactacatcaactcgctgcgcgaaggtatttgcgaagcatacgtgggtactgtttcgggcatgcgtgccggaaacaggatggaggctctgcagccttacgtcgagggcatgtatgcgtttattggtctcgtagcacacgcacagacgcaaagtcaggcatcagaaccgttgatccgcggtgcgctcggattgcttggtgacattgccagcgcctacccgaatggagagctcaaggcattgctcagcagttcgtggatcgccgagtttgtcaaggcgggtcgtggacgtggaaatggatccgagacgagaaagaccgccgcatgggctcgcgagatggtcaagaaggccaccaaataa

SEQ ID NO: 431 - DNA, 2619 bp, Aspergillus nidulans FGSC A4
atggatgtcactcaagtgttggcaaacacaatctcctcagatgctaacacacgctccaacgctgagcaacagttgctccacgcggccgaggttgactttgctggttatctcgtcaccttaggccaggaactcgcgaatgaaaactccgcttcccacattagaaccgccgccggtcttgctctgaagaacgcttttacttttagagatcgagagaggcttaacgaggttcaacaaaaatggcgccagcaaattaccccagatattaaggcgcaggtcaaggaacttgcgcttaagacgctcgcctccaaggatgggcgcgccggtcagtctgcggctcagtttattgtttctattgccgctatcgagctgccccagaatgaatggccggatttgatgcagatcctcgttcagaatgtagcgagcggatccgaccagatgaaacaggcttccctcgtcaccattggttttatttgtgaatctcaggaaatggagctccgcgagagcttggctgcgcactccaatgctatccttactgctgtcgttcagggcgcccgccgcgaggagcagaacatggacattcgattcgccgccataaaggccctcagtgactctgtggactttgtgcggtcgaacatggaaaatgagggtgagcggaattatatcatgcaggtcgtctgtgaggctacacaggcggaggaccttcgtgttcaggctggcgctttcggttgtctgaaccgtatcatgggtgcttactacgataagatgagtttctacatggagaaagctctgtttggtctgagcattatgggaatgaagagcgaagaggaagatgtagccaagcttgctattgaattctggtgtaccgtttgcgaggaagagatagctatcgaagatgataacgccgcggcccaagctgagggtttgactgatgtccgcccaatgtacggtttcgcgcgcatcgcttgccgtgaagttgtcccggttctgttgcaggctatgtgcaaacaggacgaagatgcaggtgatgacgagtacaacatctctcgcgctgcttaccaggctctgcagctgtacgcccagtgcgtacaggccgacgtcatccagcccgtgcttgcttttgtcgaggagaacatccgaagcgaagactggcgccgcagggacgctgccgtggctgcgtttggtgccataatggacggtccggaccccaaggtcctcgagcccctggtcaagcaggccttgcacgtactggttagcatgatggaagacagctccatccaggtccgcgactccgctgcttacgcgctcggccgtgtctgcgacttctgctctgagacccttgaccctgacgtgcacctccaaccccttatctcttgccttttcaacggccttgcaagctccccgaagattgccagctcatgctgctgggcgttgatgaacgtggccgaccgttttgctggtgatgtcggcgcgcagaccaacccaatttcaaaatacttcgaggagagcgtcaagtcgctccttgccctcacagaaagatcagacgcagataatcagcttcggaccgctggctatgaagtcctcaactctttcgttaccaatgctgccaacgacagccttcccactgttgctcacctatccgacgtcgtcctccagcgtctggagcgtactattcctatgcagcaacaggtcgtcagcgtcgaggaccgcatcatgctcgaggaaatgcagaccggaatcacaagcgttgtcctggctattgttcaacgcctcgaggctgaaatcaagccgcaggccgaccgtattatgcaaatcctgctccaagtcctttctactgttcctccgaagtccagcgtgcctgacgttgtgttcgccactgttggtgccattgctaatgccttggaggaggagtttgttaagtacatggagtcttttagcccgttcctcaacggtgcccttggcaaccaggaagagcccggcctttgcgccatggccatcgggctggtcagtgatatctctcgtgcgttgaatgagaaggttttgccttactgcgacactttcatgaaccacctgatgaacaacttgagcagcgccaccaaccagctcaagccagctattctcgaaacttttggggacattgcccaggcaattggagagcactttgataagtacttgaccgttgtcggtcaggttctgaagcaggcctccctggtcaccgccagcaacgatgttactatcgagatgctggattacattatctcccttcgtgagggtatcatggatgcctggggtggtattctccttgcgtacaagggcaagccgcaggcacaagctctgaaagaattcattgacccaatctttgagcttctccgcctcatctctcaggatcccgcttctcgcagtgagggtctgatgcgggcatccatgggtgtccttggtgaccttgctgagacatacccggatggttccatctccgcctacttccgcaacgagtgggtcaccagtctggtgagggagacccggaccaaccgtgaatatggtcaacgcaccattgatactgctcgctgggctcgtgagcaggttaagaaccagatcaacatgcagggtggtggaatgtcataa

SEQ ID NO: 432 - DNA, 2619 bp, Aspergillus fumigatus
atgaacgtcactcaagtgttggagggcaccctgtcgccagatgcgacgactcgtacaaatgctgaacaacaactcctccacgcggcggaggtggacttcgccggttaccttactacccttggccaagagttggcgaacgaaagcgccgctccgcacatcagaaccgccgccggtctggccttgaaaaacgctttcactttcagagatctcgccaagttaagggaggtacaggagcgatggatttcagggatcagccccgaggtgaaggcacaggtcaaggagctggcgctcaagactctcgcttccaaagatgcccgggccggccagtctgctgctcagttcatcgtttcgatcgccgccatcgagcttccccgtaacgaatggccagagctgatgaaccacctggttcagagcgttgcaaccggcaccgatcagctgaaacaagcctccctcatcacaattggtttcatctgcgagtcgcaagacccagagctacgggaaagcctggctgcccactctaatgccatcttgacagcagttgtccagggtgcccggcgcgaggagcccaacatggacattcgtaatgccgccatcaaggccctcagtgattcggtggactttgtgcgttccaacatggagaacgagggcgaacggaattacatcatgcaggttgtctgcgaggccacgcaggctgatgatctccgtgtccaggccggtgctttcggatgcctgaatcggattatgggttcatactacgataagatgcgtttctacatggagaaggctctctttggcttgagcattatgggcatgaagagtgaagaggaagacgttgccaagctcgccattgagttttggtgcaccgtttgcgaggaagaaattgccattgaggatgacaatgccgccgcccaggctgagggtgccaccgaaatccgcccgttcttcaactttgcccgtgtcgcctgcagagaagttgttcctgtcctgttgcaatgcatgtgcaaacaagatgaggatgccaccgaggacgaatacaacatttcccgtgcggcttaccaggccctgcagctttacgctcagtgcgtgcagggtgatatcatccaacctgtcctgaccttcgtcgaggagaacatccgcaacgaggattggcgtcaccgtgatgccgcagtcgctgcatttggcgctattatggacggtcctgaccctaagattctggaacctttggtcaagcaggccctgagtgttttgattagcatgatggaggatagctccattcaggtccgcgactctacggcctacgcgctcgggcgcgtttgtgacttctgctctgagaccctcgaccctgacgtgcacctacaaccccttattacttgcctttttaacggtcttgctagtagccccaagattgccagttcttgctgctgggctttgatgaacgttgccgatcggttcgccggtgatgtcggtgctcacaccaacccactgtcgaagcacttccaggacagtgttaagtccctccttaccctcacagagaggcaggatgccgacaaccagctccgcaccgctggatatgaggtgctcaactcgttcgtcaccaacgccgcgaacgacagcctgcccctggtcgcgacactgtccgatgttatgatccagcgtctggaacagaccattcccatgcaacaacaggtcgtcagtgtcgaggatcgtatcaccctcgaggagatgcaaacctcattgaccagtgtactcctggctattgttcagcgtcttgaaacggagatcaagccccaggcggaccgcatcatgcatgtcatgctccaggttctctccaccgttccccccaagtccagtgttcctgacgtggtgttcgccactgtgggtgctatcgccagcgctctcgaggaggagttcgtcaaatacatggaatccttcactcctttcctatacaacgctctcggaaaccaggaagagccagccctctgctccatggccattggcctcgtcagtgatatcgcccgtgcattgaacgagaaggtccagccttactgcgatgctttcatgaactacctgctgaacaacttgaggagtgccaccaatcagcttaagcccgcgattctcgaaacctttggagacattgcccaggctatcgggactcaatttgatgtatacttgcctgtcgtcgcccaggtccttcagcaggcatcggccgtcacagccagtaccgacgtaactatggaaatgcttgactacatcgtctcgctccgtgagggcatcatggatgcctggggtgggatccttctgacctacaagggcaagcctcaggccgctcagctccagccctacgtcgagtcgattttccagctcctccacattatctctcaggacatgagccgcagtgagggtctcatgagggcatctatgggtgttcttggtgatctcgcagatacgttccccaatggagagttcgccagcttcttccgcaatgattgggtcaccgcgcttgttagggagactaggaacaaccgggaatacagcgctcgcactattgacaccgctcggtggacacgcgagcaggtcaagcgtcaggtcaacatgtccacggcggctgccatggcttaa

SEQ ID NO: 433 - DNA, 2358 bp, Magnaporthe grisae 70-15
atgggtaaacgaaagagcgaacagcaccgaggccaccatgggcgcaagaggaggagattggcggccgaacgcgagaatgaggcggccgaggaagccaagcacaacatcgaggagcaacccgccgaattgaacataatccatgacgacttcatacctctcgatgaagacaccggtgcagcaggccctccagagacgcgcgagtattttggaatgctcaccgaagacgagcaggaggagttcaagcgactagacaatgccctcgaggacgacgacccgaacgtggaccgtgaggagctcctcgccacgatatttgaagtggccaagggcaaggaactcaagctcgcctgtagtcagtcgtgctcgaggttgatggagcggttgattctgctgtcaaacacaaggcagaagaagggccttttcgatgcctttgcgaaccatttcccgacgctcgtcactcacagattcggcagtcattgctgtgagcagctgttcttgcagtctgctccggtaatcacccgagagctgactggagaggttgagggcaacgataaggatgcacaggaggagggcgccggggacggtgcagagaagcagcccttgttgaccatggaggagctgttcttgttagtcttggatgagcttgaggagcatttgaccgtcctgatgaccgacaccttcggctcccacacactccgagtgctactcaccgtcctttccggtaggccgctgagtcaagtggcgaccaaaagcctacttcagagcaagagaaaggagcagatcgctttaccagacgggtggacagcaacggaggaaactggcgaccaaccgagagctgttccggcatgcttcgatatggcagttcgcaagattatatccgatgttttagttgcactagacccgaccatgctcgccgtcatggtcaagcaccctactggcaatccaatcctgcaactgctgctcgagcttgacattgcgctcaatacaaaagccaacagcaaacgcaagtcaaaagctcaggaagcggaggaggcaaagttggaggcagctgaagaaaagcccaaggaggaagcgggtgcgccacaaaccttgcttgagcgcctacttcccggtgcaccgtccaccttgagcgaagagacctcggaagcggcaaggtttgtcagtggcacgatctacgactcgataggatcacgcctgctcgaaacactcgtaagccattgcccaggcaagatattcaaaggcctgtggagtcacatcattgggcctcggtttgagacactcctccgtaacgagacggcaacatatgtagcaatgaaggcattggtcaggctgagtcgagaggacttggcggacgccgtgcttaagacgataccgaaagtggaaatgctagtgtcgaaaggccgcttcaatatcttgacgctgctgtttgagcgctgtcatgcccgtgaagcctctgtatcagcagatgctctgctaaaggctgtaacagaggcgtgcagcgcattgggtggatcacttgtccgcacgctgtgttatcttgacgacgaggacaccaacaaggaagaaaagaaagacaaggtcaaaaaagctgaaaaggaccaaggcgacaagaaagacaagaaggataagaaggacaagaaggataaaaaggagaagaaggacagaaaagacaaaccggccgtttctcaagagaaggaacctcttgcagatccaccaaagaagaaggatgatctcatccgcaatggcaccaagttggcaacaaccatgatacaaattggtgggaaaccggcacaggccgtacagggctctctcctcttccttgaccaagaaaagctgctgcacctagcgacatcgtcaaccgcgacagccaaattcttgacagcagccttgtccgctccgtcttcgaaccccatctaccacaagatgctggtaacggcactcaagccgcacgccatggagctcgcgcattcgttcaccggatcattcgtgatcaacgccgtcgcgctgattccctccaaggcagagggattcgcgcttcccttctttatcaagcaaagcatcgtcgagttgctgaccgctgacgatgcgagcctacgcagcactccccagggcaggaaggtctgggctgcgtggaagggcgagctgtgggttcgcaagcgggcagagtggatacggtgggcgaaggaggtcgagcccgaggaggcccggtgggcaaagacgccacagccgagagtcaaggaagagcgtccgggtcagaaaggggataagaaggatgggagaggcccgaatggccgtcagtttacagacaaagatggcaaggacaaggacaagaagagaaaaaagcaggaggcagatgagtga

SEQ ID NO: 434 - DNA, 4317 bp, Magnaporthe grisae 70-15; identical to SEQ ID NO: 23

SEQ ID NO: 435 - DNA, 5343 bp, Gibberella zeae PH-1
atggccgacgctgactcgaacccctctacagccacgcacaactcgccgcgaacatggcttctcacttcagctctgtcacccttagctgtccggctcatccgactccttctttcacatggcgactacgttgtcgcatgtctaccaccctacgagatcgatcatgaggatcgcagcgccgagtttcgtgagcttgtgaacgagtgtaagagctcgagaaaggaccgcgaagggtggaaggaccgcattcgcggcattcgatgtgacggcgcttccatgggaagttgtggtgctgctgtcgcagaagctgttcaggtttttggacggatcgacattttgttatgctgcaaatctgatgctgccacctgggctctcgaaggcttttgcgactcactcgcatatgagattgcgcccttcaacatcaaagtcacagttgttcagcccaataaggagattctgtccttaaccaatcgcctcacattcgcccctcaattgcctgcttacgaccagtaccaagagtctgccccgagtattcgcgacattctcgccaacgtcctcaacactcatccagacacggctttgccttaccccacatcaccagccgactatggaccttcgccaatgtccccaccaagtatatccatcgagccggatgtcgccccaggcgagatcctgcatcgctaccccaagctacctcccggcgcagcagataagctggtcatggagacagtccacgccttatcggcgattggaggacatgagaaccctccggcgcgccacattgttggttatgaagctgccgttgcagtaaaggaaaaactcaaaacagtcacggaagagttggaggacttcgtagaagcgagtttgtctgtggacacgtttgaaagtgagttgcaagccgaagcaagagagaggaagccgtcagaccaaagtccccaaggaccaccatcgtctacaagtgttaacgtagacttgctgccactgagacgctcaaagagtcgctctctacagaaacaccaaccacgttgcgcccgcggttatgttgagcaaacaccagatgctaggatgagcttagatcctttggcccccgtcgctcccgcgagggtaaagactcttctgttacctctggggcagataaaagcagaccgattcgctacctttgtcgagcgattaaaccagcaacatgtcgtccacctccgcgacatcagcgctgatggcagacctaacaggaatatgttctcgcctctggcttacccagatggcgctataatatacaacctcgtcactcacgttccgcctccctctcacctcgcccttactcccttcgacttataccgagaaccccttgccataatagctctggcggatggcaccgagctgcatcaaaagaacctaaataaacgacaatctatgaatggtacgggaccaacgacaacagagaagaacatcagggctctataccaggagctcgaggagctgcgcgatacctaccccaaagcccttgtgcaccacgttctgattttcgactatgtcaacccccacgacaccgagatcccaatgcccgagggccttattgatattcctccgcccgagaaatgcactgtgactaccatcaggacagtcatgtgcgacatctcctcgcttctactcgctgagatgacgacattggccaagtccttcgaagccatgaccaacatcgagtctcctgtaccttattcaacctcttcgaggcatactaatggtggctcatggggtggggaaggcggtataaatagtcttctgaaacggaattcgagcatcgtgtcttccaagcattctgcgcgttccaactcggcaggcgggattatggataaggcccaggctcgcatgtctatgccagtgaacagtcgaccaggtcttcattcgagtaactcgacgccagggttgtcatcgacgcctccaaagagtcatctatcgaacccacccatgtctacggatggtccaagtcctccggctagtgatcggtcgacaccagaaccatctgccccgccagagaccattgagagctctcgatcagctagtcgcgatcgcatatcaacccaaggctttggcgctggaggtgtgaatgaccgctggagacatagaactaagggacgagcggcagttgtcgttggttctatgtttttacaggctggtcgatggaccgattctatcaaggagctcagtgacggtgctatggctgctcggtctgtcaatgatcatttgtggcacggcaaggcgctggagctcatcttggtaaacctgttcctccttggctggtccaatatcgagtttcatgtacctacagtgcttatccagttcccggacaagccaacccataaacaaacaccggatcctacgcccgaggatcccaatcagccgaaacatcttagaaaccttcaagcactgctccctgaactgcttgaacgtatcattctcctctactccagggtgtcttcagacagccttccccccttaccactatccgaaacttatatccgattttcaaagatctaccaggctctccacctgtccaatggctaccttgatcgggaatctctaggcatgattgcgactggaatcgtccctgaccaaccccttgcggcgccaccgcgattcggtgtaacgccttcgcgacaacaaatcggagccatgctgttcaaggcattccccgcgggtgcttcggaacttcttacgactgtcgaccgagcgtccattctgagcggtatagcgactgttctggggcctttggggcttcaccgaaagaaggctatggtaataagagagcttgtatcagttcttatcggtggtctagtcgaggcaagaacccgaggcgctgccgatatgggcattcatcctgctgccggactaatgtcgttgacttctggtggcggtggttccagcagtggctcaatggccttagagattggagagtgcgatgtcgaacagggcatagaggccctgatgactctgctctgcaaatcttatggcatcgttgggtttgatttaacccgcaaggccggcgtcaagaacaacgaagcggttgatgattcggacgaggctgtgattgctaggatacgtggccagtctgcagctcgcttcttcgggttcccagacgtcaagcttaacattctaagagcttgcatcaacttttcagaagccttgccggattttgatggcgttctgcgattctcgagcgaccttttgcgtacatccggctcgggtgtagctccagggccacgacgagaggatgcgtcaccaatgattcttcgagatgagcaagtgcgactggctacgggaatatcaaggactgcgggcctggtacagaggttaggctataacgatatagcagctgagtactgggatgagttctttgtgagaggaatcaagcttgagccgtcactaactagcaaaacgccggttgctcactcaaaaagcatccttccgggtgccgccgccagtcgcgcttcacaggatgtcgatcctttcatctacaacccgtttctgaagaagcccgatgagacagtaactcagactcttgtggctgatgaatacgctaccttcaaaattacactgcagaacccctatgatatagaagtcgatgtcgagtccatctacctagctacagaaggcgttgaattcgacgctgttaaggaggcaacattagtaggaccttatcgaactcaagttatacggctcagaggtagagcaaaggaggcggggaccgtcaaggttaccggtgccatcatcaaagtccgcggatgtcgggagcgacgattccctgtcttctctatgccttgggtaccaaagcaagagctcaagattaaggccaagggtttggctgctctcgaggaggctgtgacagacatcaagccttttgccccaaagctcgaagctgaaagcatgacacttacggcaattcaagcacaaccgcttgttatagtcaagtccaccacgcttgcacagtcttcaatcatgattttggagggcgagaggcagatattctctgtgacaatgcagaatcttgcagcgacaccagtagactttatgctcttctcattcaaggactctacgcaagaacctttgcagagtgcgatcggcaatcgggatgcgacaccctctgaactttacgagtatgagcttgcactgatgaagaagcaagcattgcgacttcctaacagccagaagactcgtcatattgcgcccaatggagaggcgacgttcgaatttgaaatcctaggcaagcctgggcttacaactgcaacaatccaggtcgattacacgcatttgggatgcccacaagaagaaatgcctgaacagttttacacgagacaggtttccttggaccttaccgtaacagtcaatgctagcgttgagcttgcccgaatcgatgcgctaccagtacatggcgagattcctcagcctttatgggatcgcttgggcagttccttcacagccaagcgcgacgaatattgtctcttgtctgtcgatcttcgcaacgcctggccaagtcaaatgttggtgcaattagagagcaatgatggaatatccgttcaagaagacattcttccaggcaacacgagccgagtcatcctgcctgtcaagagggtgtacttggaggatcctcatgccacaataccaacgctcaatccatctcgaaaccgacagttcgtggtcagtgccagcaagatctcacctgagacggaacgagcaaaccgtgaaggtttctggtacagggaaagagttctcgattgcctcagagcgacatggaagacgacgtcgctacctaagagaggcggctcgattgacttgagaagcatcagactgaccacacgaatgattgaggctattaaaattgacgaggttgatattgaactatcaattgaagatgcggatggcaatgcagctgagaagggtgtggcgtatgtcgatgagtttatgcaactcaaggtgcgtgtcaccaaccgaacggctcagaaaatccaccccctcgtcagaatcctacctgcgctttgccatcggcctgcgaatgttggcctggagtttacacggaagctagcatggaacggtacattacaacagctcattccggtattggaaggacatggcagcgcagaggtttcagtgggcatgacagtgctctgtcgcggcgagttcgagatatcagcatctgtagaagaggtgcaggtctgggaaggacctagagttgcgcctacacgggcacgatcggagtcacagacgatgcaagatgctgctctgggtgtcaaggagagacgcatttggcatgcgagacagccttgtatgctgattacgagagatcgcaagtag

SEQ ID NO: 436 - DNA, 3048 bp, Magnaporthe grisae 70-15; identical to SEQ ID NO: 35

SEQ ID NO: 437 - DNA, 3438 bp, Gibberella zeae PH-1
atggccgacacaaaacttaccgaccagcaggtcgctgacctcaacaccatactgcgcagcgactcgcctctcgatgcaaaggtccaatatgtcacaatcatcaagtccggtatcaagcagcacaatgtccccgagtcgagcgtcgctcagttatttgagggcttgcgcgccgccaccacttcacagcatgcggctctggtaaatgctgggtttactgcgctcaaccacctcctcacgcgcctgtcccgtcaagatcccaagctgttgtccaaagaagcagctcgaacgcttccccttgtggttgacaagcttggcgaccaaaaagacaagttccgctccctggcctcacactctctcgttactctgttttccgttgcgccagccgatgttgaaaaatatgttcgaaacacagctatggtggggaagaatcccagagcgaaagaaacttcaatgcattggctactacagatgcacaatgagaacggtctcccttttcgaacttacgttcccgtgctcatggaactgctcgaagatgccgacggaatggtgcgagatgccgcaaaaaacactgtcatcgagcttttccgatctgcaccgaatgctgccaagtccgatctgaagcgacaactcaagacctttaaagtacggcctgcaatcgagcaggccatcgtcaaggaactgataccaacatccagtcgccccgagacacctgctgcgcccgccgagcccacaccggaaccagcaccccgcaaaacattctctgccagcacatcttcagctgctgagcgacccatcactccgggaatcgacacaaagcctgaggtcctggagccgttgtacgtcaacaccaatcgagaactcgacgacatgattaaggaaatggcgtggtttttcgaagggaaggagacggaacacaactggctgaagcgagagaattccgtccataaacttcgaaggctcattgcgggcaatgttactgatttttccgataccttccttgccggagttaagagcatcttggacggcattatcaaggtaataacctctttgagaaccagtctttgcaaagagggctgtggtctgattcaagagattgcctacacgtttggtcctgcaatggatcctttgatagaacaacttatgcaatgttttgtcaagctgtccgcaggaacaaagaagatcagctcacaactcgccaatgtgacggtcaatacgattcttagccaggttacatatactcctcggttgatgcagcatatttggtttgcttgtcaagacaagaatgttgcacccagaacttatgctacggagtggctgaagaccattctgaaaaaggagggacaccataagcaccatcttgagcacactggtggcgtcgacatagtcgagaagtgtctgaaaaagggcttagctgatgccaaccctgctgtgagagaaaagacaaggtcaactttctgggtcttttggggaatatggcctgccaaagcagacgccatcatggccgatctggatggcactgcgcagaaactcttgaataaagaccccagcaaccccaactccgcaaaggcggccgaatcagtagcacgacctggcttagggctgtccaagagtactatgggcaccagcaagcccagcagtattcgggaggctatgatggctcaacgcaaggcaaatgcagcaaagaatctcccagcccggccgggttcagccatggcccagctatcacctgaaaagatcaccactactacgtcgagcgcatcgagcaaatcttcaggggctcgatcacggccagaaactggcggtatgtcaggggctccaatgcggccgagcaggaaacggcccgagatggcggcgcgtcctgcgacggctggtccatattccgtccgcgacatggaccctggaagtcccgaaagcgtcaggtccaagacaccaaagccccgagagactactcctaagaggaccgttcctcgaacacgacccgggcacgcttcacatgctagcgaatcaagtctagcatcgccttcttctgtaagaactggtcaaaagtcagcggcatctcctcgagcgagccctaccaagctgaagcaatcgcaatctactatgttgtccatgagcagtccttcaagagctgatgaggacttcactatgctggttcccagcatggccaacttcagaacttcgcaaagacctgcaccaccacctcaaagagcggcctcagtaccaccagaggccccggaggagttgtcaactctggtgacggagattgcaccacagaacattccacaggccgcagccgagcctacatctcagccaacgttagagccggagctggagcctcaacctgagccagaggcaacccccacacccgtggttgacccggtggccgaggctgtagatcaaactatggatgagactgttaagcctgaagagcctgttcatatcattccagagcccgtcattgagcccactcctgagccatcggcatctatgcaggctgaccaggctccagcagcctcagctcccactcttcaggtctacgaagaccctttcactgatgaacaaacaaactcaaagccgaccttcaatctccctgtgctggaagacaagcctgtgaatgccgacacggccagtctacccagtgttcatgctcaatctcccgtgacacaaaacatagaggcccctgacagagccaagcaaagtttacggcttctagaaagcggcatcaaaagaatcaaggcaaaaactctcgatgtgcatggcttccgaaagctgcagtctctcttacgcgacagcaagggcatctttgccgatgataaatttgaagctcttctgattggtcttttccaatatctggaggatcccttgagcggtacaagccctgagaaagctcaggatatcaaggctcagatccttgctacgataaggttactcttgaaaaaggaacgcgacaacttccagcctcatgtttcaagaggtcttgagtcgcttcttgagacgcgcagtgcatatgacatccgcgcccacattgtcagcggtgttgaagtgcttgctgacgagcttgttactattggtgatgggtctgagattgtggttgttctcacaaggcgtctccagaatgttgatagttctaccactgagggtagccgcattctcagcactggtatgcatgtgttgcgaaccatgttagataagagacccaactttatgcctactggcactgagcttggccagttggctgctctcgctggccgatgtctcgcctctgcagactctggtgttcgcatggatgccgttcagctttgtgtcgctcttcactcaagggtaggcgagcagaccttctgggacgctctcaaggatgttcaggacgaccccaagagcttgattacgtactatattgttaagagacaacgtgagcaagctcctacaattgctgcctag

SEQ ID NO: 438 - DNA, 2496 bp, Magnaporthe grisae 70-15; identical to SEQ ID NO: 29

SEQ ID NO: 439 - DNA, 2394 bp, Gibberella zeae PH-1
atgtctgcgccatacacgccccaggacgtgcaagccgtagcggctgtcgtgcgtgctttggataatgctcggaaagacaagagaaagaacgggttctcagtcaagaagaccagtttcgacgtaaagggatcggctgatggcattcaagtcgagtcgtggcgcatgcaggactgggactacaaacgacctaatctgccaacatacgcccgtggcctcttcaccacaaggacacgaagaaacgaaccagaaatcgctgtgagaggctatgacaagtttttcaacgtcgaggaggtccccgagactaaatgggaaaaaatattcgcacagacgcaaggcccttacgagcttaccctcaaggagaacggctgtatcatttttattgctgggctggaagacgataccctggttgtttgcagcaaacattcgacaggagaccgagaagacattcaggttagtcacgcaagtgctggagaacaacgtctggagcagcagctggctgctgttggaaagacaaaggcagatcttgcacgagaacttcgcaagagaaacgttactgctgttgcagagctctgtgacgacgagttcgaagagcacattttggagtatggccccgataaagccggcctatatcttcacggcatgaacctcaatttgccgcaatttgccacctacccaagtcggtatgtccaggagtttgctgacgagtgggccttccgaaagactgggcttatggtaatggacgatatccaccaggtcaaaagctttctcgaagaagtggctgaaactggggctcacgatggacgagatgtcgagggttttgtcatccgctgcaaaatgtcacaagatccagccacgcagcccttccaggattggttcttcaagtacaagttcgaggagccatacttgatgtaccgccaatggagagagtgcactaaagccctgattgctggcaagcagccaaagttcaagaaacacaccaaaattacggaggagtatcttctttatgcccgaagacgacttgttgcagacccgaagctcggaaaagagtacaatagcaaccacggcatcatcgctcttcgcaacgacttcttgacttttaagaatctaaagggagcagatgcggctaatctaggcgacctggactgtccagccatgacagaggttactcgggatgtgatcttgtgtcctatcgccaccatcggttgtggcaagacgacaatcgcgatggggctatcacacctatttggctggggtcatgttcagaatgacaatatctctggcaagggccgccctccacggtttactaagatggtattggatgagctgaaagaccatcctgccgtggttgcagaccgaaacaatgcacaaagacacgagcgaaagcagattattacggatgtcaagcttcagcactctactgctaaacttgtatgtctgaacttcaaacatgacgaagaagcgattgatgagatccgacgaattacacaagaacgaattgttacgcgtggggacaaccaccagacgattcatgcagcaagcgataaagataaatttattggtgtgatggagggtttcatcaaacgatttgagccttgcaaccctcatgggcgacctgacgacggcttcgatgcgttcatagaccttgaccccacagctggtagtcgacaaaatctcgaggttgttgtaacgcagttgcacaagctgttccccaatcttgtgggggagattccatcttcagggacgcttgatgctgccattgattgtgctctcggatacaagccagaattcaggcatgatatacctgatcggggcaagaagaacagccagcagcaaaaacaacaagtgaagacgccaaaaccaaggaagatggagtacatgtccgtcagcatcccgacccaagatgtcaacagcgctctcgataacgccttcagaaacgtcccggcatcaacctctcaattgtacacacaactcaagcaaacaagacgtgtacagccaaaattccatgtcaccctgcttcacaaggctgctagcgttaaccatcccgagctttgggagcagtataccgctctacataaggaggtagaagctgctggtaaccctgaaggaaaggtcggcgaatgtgatgtaatgcttgaaagggttgtgttcgacgatcggatcatggccattgttgttcgtctggcagatcaggatgaccggtggcagtgtgtgaaccgtgtcgcgcatatcacagtcggaactcgagacaatacggtgaagcctaaagagagcaatgatctcctagccaggtggctggaagtgggcagctcccccgaaaccaagattggcgaggttgtgtttgcggggaggccgactgtgaagggaacagtgatgcctgtgctgagccgattctga

SEQ ID NO: 440 - DNA, 2433 bp, Aspergillus nidulans FGSC A4
atggcgaaggccttggaaggcgctaggctggaaaacaaaggagccaagaagaagaccttcaactgcaggaagtccacttttaaggtgggtaaggccggtgatatctctgcggattcttggaagtttatggactgggattacaaacggcgcgatctcccgacctacgctcgagggctcttcactgcgaagaggaaggacggcaccacagagatagtcactcggggctacgacaagttctttaatgtcgacgaagtcagcgcaacacagtggaggaatattgaagcgtataccgaaggcccgtatgagctcagtgtgaaagagaacggatgcatcatatttatttctggactcgaggatgggtctctgctagtctgcagcaagcattcaaccggagctcgcgcggacaccgataggagccacgcgcaggttggtgaagagtggattgagcggcatgttgcgacggttggcaaatctactgcggaattggctaagcagttgcgtgagatgaatgctactgctgtcggggaactatgtgatgacagctttgaagagcatgttcttgcgtacgattccgctgctgcaggtatctaccttcatggaatcaactataatctgcctgagtttgctactctccctagttcagaggtacataggtttgcggatgcttggggattcaagaaagcgaattttgtggtttacgatgacctcagcactgtgaaaaaattcctggagaagtgcgccgagactggctcttgggatggccgggacaccgaaggtttcgttattcgatgcaaaatgagcgagaacggccatggtccgtaccgggattggttcttcaagtacaaatttgaggagccgtacctgatgtatcggcagtggcgtgaatgcaccaaggcaattctctcaggaaaagcaccgaagatcaagaagcataagaagatcacggaggagtatttggcctacgcccgtcaacaatttgccctacatccgaagttaagggaacagtaccagcacaatcacggcatcatctctatgcgcgacgggttcctcaaggagcgtggactcaacggagctcagatcatccaaatggaagctgaaaatgttacacgggatgtcgtactggtaccaattgcatccataggctgcgggaagacaacggtaggcctggctttgacgaagctgtttggctggggccaggtccaaaatgacaacattcccaagcagaagaacaagccgaagcaattcgttgcgaacattctaaatcttttaatggacaagccggccgttatcgctgaccgaaacaatcatcagaggcgcgaacgctctcagctgataaacgatattgttgcgggttctccaaatgcccggtttgtcgctctgcattatgtccacgagccgaaagatatgatgctccctctgatccgagaggttacccgcaagcgtgtgctcgaccgtggggataaccaccagaccattcgtgcggggacaaaggatacagacgaggttcttggcatcatggagggattcctgcgccgcttcgagactgttgatgtcgatcatgagccggaccagaacttcgacgaagtcatcgatcttgatgttacagcgtcctcgcgcgaaaacctcgaaaaggttgttaatgccctacactcggcttatcctcagcttgtgacaaaggtcccatccgcccaggaactcgacgacgccatcaactatgctaccagcgagtactccgtcgaggtcgatcacagcgcctcatatggccagtccaaaccttctaaacagagcaataaaagcaacagcaacaaaaatggcggctccgaaataaacattgaagccaaggttcgaaaaatcgaatacttcggcatctcccttcccacctcctccgttactgatctccttcactccctcttcgccaacccagccatcactcctgaaaaagcccgcctttaccatcatctcgtcaactcccgccgggtccagcccgccttccacgtaaccctgatccacaaagccctcaagacagctcatccagatgtctgggaggacctggtcaaccgatacgttgggcagatgaagaaaaacccaccgaaagaccacgcactcactcctcccttagggtctgcgcgcgtccgccttgagcgccttatctgggatgataagattatgacgtttgttgcgcggatcatgcctggtgagccagaaaacagtggtgacaatgctgagccccagccagactggatctgcgttaatccacttccccatgtcacggtaggcacggtttcgccagccgtcaagccaaaggagagtaatgatctgttgcagaggtggctgcaggagggatcgcagggtacgggcatctgggagatggagatcccgggggtgaaagtcgttaacgggactgtaaatgttactatgagtcggggcaaataa

SEQ ID NO: 441 - DNA, 2505 bp, Aspergillus fumigatus
atggttcaacaggatcctcaggaagttgcgcatctggtcggagccctggaggcctccagtaagaagaatagaagcgaaggaaagagaacatttacttgcaagaaatctactttcgccgtggcaggctcagataatatctcagttgactcgtggaggtttatggactgggactacaaacggagcaatcttccgacctatgcccggggtctgttcacgagcaagaggaaagacggcactcccgagattgtagtgcgcggttacgacaagttcttcaatgtcgatgaagtacctactaccaagtggcaaaatatcgagacaaacacaagaggcccctatgagctcagtgtgaaggagaacggatgtattatcttcatctccggcctggaggacggctccttgctcgtttgtagcaagcattcgactggcgttcgacaggacaccaacctgagccacgcccaagccggagaaaagtgggtcgagcgtcatgttgcttccacagggaaatccgtcaaggatttggccagagagttgcgcaggctgaaccttaccgctgttggagagctctgcgacgacagctttgaggagcatgttcttgcctacgatccggcagctgcaggaatatatcttcatgggctcaatttcaacgtgccacagttcgcgacattgccgagctcagaagtacataactttgcagatacatggggtttcaaaaaggccaaatacctcgtatacgatgacatccattcggtcaagaagttcctagatcactgcgctgagaccggcacttgggatggccgtgagacggaggggtttgtcatccggtgccagctaggcgaaggcggaggcccgtacagggattggttcttcaagtataaatttgaggagccatacctgatgtatcgacagtggcgtgaatgtaccaaagcgatcattgccgggaagtttccgaacattagaaagcaccagaaaattaccgaagagtatcttcattatgctcggaggcagctgtcccagaatcccaagctgggcgatctctataaacagaatcatggaatcatctccatgcgagaaggttttctcaaggagagaggcttaaagggatcggatatcatcgcgatggaagccgggaaacctgatgaagtgacccgagacgtcattctagcacccatcgcttcgctcggctgtggaaaaacaaccttggctctcgctctaaccaagctttttggctggggccatgttcagaacgataacattcccaagcaaaagaacaaaccgaagcggttcgcattcgaaatcgccaatctcctcgcggacaaaccagttgtgatagcggaccgcaacaaccatcagaggcgagagagagagcagctcatggaagatatactccctgggattccgggcgcacggtttgtagctctccactacgttcacgaaccaaaagacgttttacttccttcgatcagagaggttacacgcaaacgcgtcttagagcgaggagataatcatcagaccatccgcgccggaacgaagaactcggatgagattgtcggcattatggaaggtttcctgaagcgatttgaaggtattaacagggagcgtgaacccgacagcggatttgaccatgtgatcgacttggatgttgccgcatcttcacgagagaatctcgaaactgtggtgaacgcgctgcattcattctacccggaccttctgcggcgggttcccacgtcgcaggaactcgacgatgctgttacctgggcgatgacggaataccatgtccaacttgacctcagctacagctacggttcatcgaagccgagacagaatttgaataagaacaagggtcagaatgacggtgcgtcgaccgcagcacacgcccagccccaggaacccaccccaagccccgaagccctagcccagaagatcgaatatttctgcatatctatcccaaccgccgaagtgaccactctcctacattcgctcttcccaccctccacacctccagaaaaggcacgcctgtaccatcatctcgtcaactcgcgccgtgtccagcccaccttccacgtcaccctcatccaccgcgccagcaagaccgagcgcgtcgatatctgggaccgctacgcgaaccaatatatcgccaaaatgaaggagcagtcccaggcccaggcccataccgcaagccctgtcctgaccccaactctggcgcctgcgcgggtccgcctcgagcgtctcatctgggacgaccgcatcatggcctttgtcgcgcgtatcatgcctcccggggaccgcgagcagcccgactggccgtgtgcgaaccccatcccgcacgtcaccgtcggcaccgcctcggcggaggtcaagcccaaggagagcaatgacttgctgagacggtggttggaggttggatcgggcggggacactgggatctgggaggcggagattcccggcgtcaaggttgtgcagggctctgttgggatggtgatgagtcgggggaagttgctgaaatga

SEQ ID NO: 442 - DNA, 2508 bp, Magnaporthe grisae 70-15
atggcacctggtagcagtggtgccaatgtcgcagcactgttacgacacgcagtgctataccacctcgacaacagtgcacacgaaaatgcgctctttttcgccgaaagactcgctgctcaggaccctcgatcccccgaatcagcgtttctccttgccctctgccatttccgcctgggagattttctgtcggcgcacgatgccagcaaggacgacttgaagggagcaggccttcggagtttacatatagggcgggcctacatatttgcgcagagctgcttggcactagaaagatatcgagatggggctatcgcactggagaggtgtcgaccgcaatggccgcataaaaccacttttgggaaacacacggcctccacgcgcagcctgatacctgatgctgccgcgctaaactgcctgcttggtaagctctatcaggggcttgacgacaagaacagggctgtatcctgctttgaggacgcactgaagctgaaccctttcatgtgggatgccttcacatcgttgtgtgacatgggtgttcacatcaaggttccaaacatattcaaggtcaccgacaagcttgtgcgggctcttgattcagaagataaacccacgattaacgacaaggaaacatcttcagcagctacattagagccgctgccgagaaagtcagctttgcgttcggcccccgcagacacctcggatcccttcgaccaaccaagagcagtcgccttccaggacagacaggcactcgggaatctggtagccgccgagaccgaagaaaatgagtttctccaaaagatcgcagctgctcgctctaggatggcagcagcttcaggaccaagcagtgcgagtgatctcctagacactcctccagctccttcggctccggtggagataaacgccttgcgtggaggggctcatcctgagcctccgcacgcgcccatgcgcaaaactagggcagcgcatactattgaaccacctccttcggatgccccgccaaggatgggatatcgtggcatcactaaacgaagagcaaatttggaccccaactcagaagccccttcagccacggagcagcccgtttcccagatgctcagaacttcagcgtcatcactgttgggagctgaacagcggaagcggaccatatctgggcatccagtccaatccaggccaggtgttaccgaagaacccggagcaccacagagaagaagtgccaggctcaacatgttcaagcagccctctactgccaagccgaacgctgcagctgctcccattggcaccacatctacgagggaaatgaagaaagccagaccagccatctcgagaatcatgcggccagggagtagcggttctagcgttgggagggttgtgagtgggaaccgaaagccagtggaggaaaataccatggatgttgatcatgtcgagcccccgaagatgagagatgcagttcaaccacctctaggacctgcaagaacaatcgaggcggacggacacagcacagtaagattagaagaaaccttgcggttgttgatggatcttctcaaacgcctgggaacgggatatttggctttgtcgcagtaccagtgcagcgaagctgtgcaagctttcagcacgataccgcgagctcatgtcgacaccccgtgggttttagctcacatcggacgcgctcagtatgaacagaccaagtatgctgaagcagaggcctccttcaagcgcttaagaacattggcaccgaatcggctggaggacatggaggtctattccacagtactttggcacctgaagaaggaaacagaggcatcgtttctggcacacgagcttgttgacatagcgtggcattcaccgcacgcctggtgcgccttgggcaatgcatggtcgctggcatcagatcgcgaacaagcgctgcggtgcttcaagcgtgctacgcagctcgacgcaaaatttgcatatgcctacacacttcaagggcatgagcactttgttagtgaagaatacgataaggcgttgacatcataccggcacgccatagcggcggaccggcgccattacaatgcctactatggcatcggaagagtgtacgagaaacttggcaactatgacaaggcatatacccacttccatgcggcctcagtgattcacccgaccaacgcggtcctgatatgctgcatcggtacggcactggagaagcaaaagcaagttgtacaggccctgcagtttttcacaaaggcgaccgaactagcaccgcgggcagcgcaaacacgcttcatgaaagcgcgcgctcttttggcgttgggacaactacacgaggctcagaaagagctcatgatcctcaaggacctcgcaccggacgaggcgactgtgcatttcctgcttggaaagctctacaaaacacttaacgataagaatacggcggtccatcactttacgattgcactgagtctggatccaaaggtaagccagccgctgcatgtcaatgttgcttttcttgggctacccaacggtgatggctga

SEQ ID NO: 443 - DNA, 2472 bp, Gibberella zeae PH-1
atggctcctaccccgacggccgttaatggccttctaagacaagtgatacattaccatcttgacaacgcctcatacgacaacgcccttttcttctccgaacgcttgacggcacaagacccaaggtccagcgagtctgcatacctctactcgctatgccatttgcgtcttggtgactatcgctccgcttacgacgtgagcaaggccataggatatcgaggtgctcatttgggctgtgcctgggtattcgcccaagcatgtttggcactcgaaagatataaggacggcctatcggccttagaaaaggctcggggcctctgggcgtcaaaatgcagcttgggaaaacacagcgcgacggcccgaacggctcttcctgatgcgcctgcagtactatgccttctgggaagactgcaccgcggctatgatgacaagaaaaaggccgttagctgctatgaagaggctctgcaactcaaccctttcatgtgggatgccttctcagctttatgtgaccttggtgttacagttcgcgtaccaactatttttaaagccaacgaccccattgtccatagcttcgatgtggaaacaaacccaatgatatacagggaaggctccgtgccaatcccttccgacctacccgcaaagaagtcgcaaagaaacgctgcagcggatgttgggaacgatccgttcagctcaagtcacaaccttgacagcctcgagctgacaaacggcgattctagtcaggaagtccacaaaagcgacttcatgctgaagattcaggagggacgtatgcgctgtacagcatcaactaatagtagctctggcttcgacggaatggagacacctccaggcccgatatcatcattcacgacatcatcccgcctcggccaatctcatgagcctccccaagcaccgcctcgccggacacgacaagcacaagctattgaccaaggacatgacgctcctccacgaatgaactaccgtataggttctcggcgcacaagggcgcaagagaagggacagcaagagcagtcaaccgaaaacataatgactgacgcatccaactcggcaccttccgcatcgttgcgaccgtccataccagcagcggaaaggaaacggactgtatcaggacaccccgcacaacgagcgacaaatacagaggagccgacaacaacgcggcgtagtgcgagactcaacatgttccgcccattatccaaagcaaactcaagcgcgactacaataggaacggcagcccccagggaattgaaaaaggcgagaccccccatctctcgaatcgttcgacctggttccagtggcaacaatgttggccgtgtggttagtggtaatcgcaaacctctagaagatactcatgttgagattgaccacggcgaagtccaaaaacccaaggacgtaccgccacctcctcccgttcacaagacattggagttggatgctcaaaggctcgaagaagggcttaaatggatacttgaccttacaaagaagctggcgaatggatactattcattgtctcaattccaatgcaccgagagccttcaacatttccaatcccttcctgtgtctcatcagaacaccccctgggtgcttgctcaaataggacgggcgcattatgagcaggcttcatacgccgaggccgaaaagttcttccggagaatgcgagtgcaagcgccttcccgtctcgaggatatggaggtgtattcgaccatcttgtggcatttgagacgggagacagacctctcatttctggcgcatgaacttgtggactcagcctggctgtccccacaggcttggtgcgcacttggcaatgcctggtcattagcacgcgatcacgagcaagctctcaagtgtttcaagagagcaacccaactggaccccaagtttgcatacgcttttaccttacaaggacacgagtacgttacgaatgaagaatatgacaaagcgcagacggcgtaccgacaagcgatatctgccgataagcgccactacaatgcctactatggtattggaagagttcaggaacgtctcggtgcatacgacaaggcgtatacgcactttcatgccgctcaaagtatcaatcctaacaacgcagtcctgatcacctgtatcggaacagtgttggagaagcagaaacaaataatgcctgctcttcaagcatacagtaaagcagtagagcttgccccccgcgccgcccaaacacggtacaagaaggccagagcgctacttgctgttggccagctcgaacaggcacagaaggagttgatgatattgaaggacttggcaccagacgaagcaacggtccactttcttctcggcaaactgtatagaagcatgggcgagaagcagctctcagtgcggcactttactattgctcttgccctggatcccaaggcaagccagcagatcaaagaagccattgagagtttcgaggacgacgtggagatggacgactcaatgatgtga

SEQ ID NO: 444 - DNA, 3216 bp, Magnaporthe grisae 70-15; identical to SEQ ID NO: 25

SEQ ID NO: 445 - DNA, 7728 bp, Magnaporthe grisae 70-15; identical to SEQ ID NO: 19

SEQ ID NO: 446 - DNA, 7668 bp, Gibberella zeae PH-1
atggtgccgtcgcagccgcagccggaccacctgcaggatacactcaggtactctccccggcctgtccttagactcgacgaggaggaagaagaagatgagaggagctgggaccgagcattacgccctgtagcttcagattcgccggtcatcaatcgatttggacactcacgagactcctccgccgaaaagatcgcacagacacaccaacccgtggtctccccacgactccacggatcgcattcgagaagcccacttggtggtgtcgttgaacgaattattgaccccaagagcgcagcctacggccatcatcgtcaaacttcgatcgtgcacggctaccaacactcgagaaatggcagcttggcctcgaccagttccagtccgttaagcccgcagatgattgcagccgccggcgtcggcctcgaacgtccagacatgcaatcggtggccacccgtatcgatggcgacgcaggctacccatcgcggccccctacatccctctcaggaaatgttgcgaccatggaacgtcctactgccgctgatgcttcttatggccagacccaacgcaagctcgaacgaatacacagtaaatcgcggcgcgaccacaccccccatcactctcactcgtctcgtcaccataaggacgagcaaaagacggttggcgaatatgcgctgcatgtgttgttcacctcatttatcgcacaagccgaagaaaagttaacggaatgtgttacggttcctctcgaccccgagcccaacgtcgaacaaatatgcggcccaggagttgacccggcctttgatcaattgattgtcgctctaggtcacattgctagcccgaaaccaaaagcattgatagactccatgatgctctggaggaaaagcaaaagtgatgccgccaatgaagcccgcagccatcttcagcaatcccggaatgcagtgccaggaggaggacctcttattcgaagaaatacagaaccagtgcaggccggaatacctggccagggaggtcctgatgctgctttcccaaatggtccgcctactctcgcagcaagacaagagtttgtggcacaagctgagcgtcggtcaactgtgtctatatacattctttgccgtgttcttcttgaagtcatcagccaaagcaatcttgcttcgatcacgcctgaaatggaagacaagctggagaatattatctttggacaactcaagattgcggatactgatcaattgatggtatcgcccctcaagcttgctaattggaatctgtttgctcaacttctggggcatatgagtggcatcaattttgttggagtcaccaagaggttcatcgaagacttggaaggttcccttcaggctcgcgaacgcgtggtaaagagtccaacgacatcttcgcatcctggccgagatgtcgagggaaaggtggagcttgtactgggaggcatgaaacatctgagactcaagatttcacctgaagaatcttgggaacaatgctgtgatttcctcatctcccttggtcgtctcttccagaagtcccatggacaaaagatcaagacagccttctgtcaggtgatagagatgcttctacttccaatcgcagcaaaggcaagcaatagccatttcatgcatccgaaatgggcagaagtggtcgctgccatcggaccccgtctagctcagatgttcatgaagcctaggcattggaattttgcatttccgcttacagcgacactgctttgtgtttcatcccctgacaactttggttcccaatggttgcaattgatactacctctgcaggccaagatcaaggatcgagccactaagcctctctgtctccaggtcatctcacgcttactatggacattcttatatcgcactaatgagacttttcaaagcagcatgcgcaagattgacgaggtcatgaaactggttttgccatcctccaagcgaagcttggttgcctctgatactgcttgtactgagcctttaatccaaatcattcgaattgttggcttcaagtatccggaatactgcttcaggaacgtggtgtttcctctcatcaatgccgagctcttcatttccaataaagagctgaaggtcgagcagctggaccccgatagagttgtagtgggtatcagggctttcctttacatcatgtcagatctggagaatggcgaacaaggacggccgccatttccccaatctttcggaaactcgagtcataattcgctgcctgaccgattccctgtctctccagctatgtcatctcctcgcaacctccctctttctcagccagctgcgatttctaaagaagagtatatttctcgccctgtcttgacacacgttttgagtgatggagtccgggatttttacctcaaattttgtgaaatcctcgggaagatcacgatcatatgtgacaacacctttggcggacaagcagcactggatgagaaattcaacagccctatgccgaaaacccccattactgaaaccttcaccttctcccgtaaagacgatcaccagaacgccgcagatcagaagcaggcattctacgaacttcttcacgtagctgttcaagcgttacctagatgtctttctgtcgacattccatttaactctctggtcaacttgctgtgcactgggacagcacatgtgcaatacaacattgccgagtcgtcagccaattctttgaaggccatcgcaaggcagtcacacgctcaacaggtcacaatgggctttgcccgtttcatattcaattttgacgataggtactcgacgatgtctgacggtggaatgcttggtcatagtcacattgaaaacaccttgcgcttatacgtggagctactgcaaatatggattgaggaaatcagacaaaagactagagatgccgctacagatgagccggaagccaacgcgtcagacaaacgagccataaaacttgacctttccagcatttgggcagaggttgatcaagcagaggctcatggattgttcttcctctgttcccaatcacgccgagttcgccattttgcagtcacagttctacgtttgattgttgagttcgataaggcactccgaaaggaagcggccgaagacaaagactccatacgactcattgatattcttgagaatgaatccagcaaggttatggatttcaacgatgagcagctgtctgtcgctgaacgaagtcgattgcaacgaggcctgcagaataccaacaaccagggcccacttgttgagctttgcgccagcgatgtctcttacgacacgactctatggttcaaaatattccccaaactcattcggatggcctatgagaagtgcccctttacagtcactatatgccgtgatcttatctgcaatcgcattttacaaatgtataaaccgatcgtatacctctccgaaccctcgcgaggtctctactacaacaacgagacaggcagtgcccggcttggagcaagatccgcaacaactcaacctgaggtgatggtggagcaatggaaattgtacttgatatttgcttgcactacgctagcagatccaggtgctttgcccacgccgcaggatcctcagcatgttcgaatggcctccaaggcatcctccaaagataagattgtgacagctcggatgttgttcaagtaccttatccctctgttgtctgtctcgtccgcgtctgttcgggatgccgttgttgttgccatgggctccatcaacattcatatttaccggactttacttgaggagctgcaaggtcaggtttctcgatgcaatgacgaggcgcgagctcggatacaccagcggacgaacagtaatcctaggaggaataggcggatggatcttcttagaacggaaatcacgcacgttttcaagcttacttcacatttccttaacgacccggaggtttacaacaacgagttcttcttgactactctcactacatacacaaaagacctgaagttgttcctcatggatggagaggtccagatggactgggaatttcagaaactccggcgtcattattgtggtctgatggaggcactttttgaaggtatcaacaaaaccaaagatccatcccgatggatgaccttcgagtctcgcaagtcggccttttcgctcatggaagattggtgtggattttcaccgaatcaaaaccagattcgtgttcgcgaagataccatgcgccagtccctgatcgatcagcagactttgggggagagaggaactgccactgctgcaatggagatagaaaaaaggaaccttcgcactgcagccctcagtgccatggccgctttatgtggcggcccaattagcgtcacgactgaaagcaacgttgttcttcagtttgatattcgacgtatgcttgcttggattgattccatcttcaactctgggagcgacaagatgaacgttattggtagaagagctttgcataatctgattgtccacaatcgagaggttccttacttgatggagcactgtattatgcgatgctacttggcagaggctcccaaggtgcttgaaagttatttcactgtggtcacgcaagtcttgcaagatcacattgactacccttgtcccttctggaagttacttggcctctgccttttcactctgggcaatgatcaaagtgagattcgatccaagtctgcagttgttctacgtagcttggaagtccgacagcagagaaactcgaagatccaggatttcgacatcagcatttccgacaaaacacaggctgtgtacaagctagcacaattcgagatctccacccgacttgccaaacagcataccgagttagcctttcacatcttctctgaattcacactctactttaaagaccttcagcccgcagcccaacgaaatgtcgttgcagtaatgttgccctggattcaatctatagagttaaagctggatccgagtggtggacccgcagcaccgtctttcgtgcttctcgcaaacctcctcgagatcactatcaaatccagcggtgccctacacaatgaggttcaggctctttggcaggctcttgcaacagggccttatccaggcaatgtccgtttggctcttgagttcatcatgcagctgtgtcttgagcgccgagagcaaaattttgtcgagtacgccaagcagattgtcgtgtttctttcaacaacgaacagcacgcctggcatcaaggttgtggagttcctcctcatgcaaataacccccaaagcaatggtgccgaacgaaaaacgagatgcagttgagccaccggctgacatcaatcttttgccatactgtgccgatctagctgaggctcttcctgttggaaccaagcaagctggtttttctcttggccagttgtcccttattcttcttgtcgatttgatggtctccccagtccacctcacactggagaacgttccgctcctacttcaagttgtcactgttctatgggatcattacacgccactggttcaggagcaagcgcgagagatgcttgtacatcttatccacgaagtagtaatttcccagattgacgatcagacacaagacgttgacaaaagagctatcgaggacctgatagatttagttcgccggcacgatcgatccgtcgtttgggggtatgaggatagcaacggcaaggtggatgatcacgacagcaaagtgccaccaagcatggagttccttacggcagaggtcatcaagactttcgagattacattcccaggcatcaaagagcattggggacgactgtcactaacctgggccacatcttgcccagttcgacatctcgcttgtcggtcattccaaatttttagatgtgttctcacatctgtggaccaagctatgcttggagacatgcttgctcgattatctaacacgattgcggatgaggacccggaaattcaatcattttcgatggaaattctgacaactctgaagacaattattgtcaagctagaagctgaggaccttcttagctttccgcaattgttctggactacctgtgcttgtctggagtcaataaacgagagggaattcctagaagcagttgagatgctcaacaaattcatcagcaagctagatctgagttcgcctaatgtgcgccgaatacttgcagatgggcaaccatctcgctgggagggaatattcgaaggtgttcagcctcttctccacaaaggctttaggtcgtcgctttgctggcaacctactctcgatacgatagacaaattggttcttctgccgagtgacgggttagtcggtgatgatagacgcctgttcttttcgctacttgccaatttccctcgctttctcaacgaattggagaaacctgttccagatgagagtgttgtgcacacagcgagactgcttcaggaggaagcggacaaccaggggttggctggtgttgctgaggccctggaggggtttgctttaggtgaccctcaagatagtagcaaggatttcctcattgagttctggggagctttacgagagtactatctccctcagatggatttcccgatggtaacctttttgctcggccttctaaccaattccctatcctgggtcaagatccagacaatgagaattctctgtgctgcgatccccgaagtggacatgcgtaagccggaacttgctgggcacggatctgacctgatctcgcctctgcttcgactgctgcagacagaattctgcatggaggcgcttgaagtattggacaatatcatgaccatgtctggtaaccacatggacaaacaccacctgagaatgagcatgacgcgaccgacgtcaaaggcgattcgaaaggagtatgagcgcacgcagagtttgtttgggattcccgaaacgtcaggatgggctattcctatacccgcaaagaaaactgatgctacgcgggccaatatccacgccgcgttttacacttgccagggttcagagggcatgctgaccgagacagcacctacgcctgatgtagagtttcatgccgatgacttcccgtacaactactttggtgcaccggagcgaaccgaaaccatgttgtctgacgagggtcgtggtgatgttcacgcagcagacctggcaaccaagctggacagtcttgacgacttctttgatgagccgtcgagccctacgactgacgatgatggccggtcatcaagaacgatcactgaatatacaccggagtcgtttgagactggagcagagctatatgatgagcagaccctgcctatcctccacgaagcctcgaacaatgcctctttccaaaatggcttcgcagaccgatctccagggctgtcgagagatgcgagctcgaacaccatgacaccgggtgccttcagtgtggttgttcctgcagcgcgaccgggattgcattctagatccatcacgtccccctccgcgccagcttcttaccaaccacaaatgggcgacattgtatccgacgatgagtaccttgggggttactcggacgccgacgacgagcgacctggtacgggacataccgagggcgctttttacttggagaatatgatcaagcctgtaactcgaaggccgcagtcgaggataagacgccagccaagcgttcgttcacgagacgagagaagtcgcgaaaagccaccgcctcgatcggcatcacgactagcaaacaacgtatatccccctgggatgcaagagcatgcggaaggtgacatgctatga

SEQ ID NO: 447 - DNA, 4839 bp, Aspergillus nidulans FGSC A4
ctgtccagcgttttagcgcaagtcgaggaagtcgaatctcacggcttattcttcttatgctctcagtcacgggtggtgcgatccttcgctattactgtgcttcgacttataacagagtttgacagtgctctcggcaaagagaacaccagaataatcaggatacttgaggctgactctcagcaaattctggatgtcaacgacgagcatctaacggtcgccgaaaggagccgtattcaaaaaggaaaacgacggagtgcctcccaaaatactctaatagagctttgcagcagcgaggtttcatacgattcgactttatggtctaaggtgtttcccaacattatccgcataagttttgagacttgccctttcgctgtcacactagggcgggaaattgtctgcgcaaggctcgttcagatgcacaaagctatcaccgccttggcagaatctccgcagcaccctcagtatcctcccatcgaccctgcgcaagctcgcttgctggctaggaataacacgactgcggaaatcatgattgaacagtggaaatcatacttggttatggcttgtacaacactcaatagcgttggtgcacagtcccaaagtcaactggccaacgcccagcataccaggaaatcatcaaaggggtcacagtcgttcgacaagatcgggtccgctagaagcctctttgcgtttgtgataccgttgctttccgccgaacgtgcgtccattaggaatgcaatagtggttgctttgggatccatcaataaatacctttatcgaatactcctcgagtcgctgcagtacgctgttacgacttgcaatgaagaagccaagattcgaattgggacacatcatcgaacaccaagtagcccccgacgaagccgaaagacggacaggttacgaacagaggtaacgcatgtgtacaaactaacgtctaaatttctgaaggaacccgaagtctacaatgatgactggatcgttaacaatctcgtgacctatgccaaggacctacgaatattcctcagcgacgcgggtgttcaaaacgattgggaatttcaaagcttgcgcttccactattgtggactaatggaagaactgttcgagggtgtcaaccgtacgaaagacccgtcacggtggattccgtttgaggcacgcaaatcttccttttccctgatggaagactggtgcggttattccccgaaccaagctcaaatctcccaacgggaggagcatatgcggaagcttgccattgctcagcgtcaggaggcaggcggggaactacgaggtgccactgcagccacagaaattgagaagcgaaacctcagggcagccgctcttggtgcaatggcatccctttgtgcgggcccaataagtattactacagagagcggctcagtgctccaatttgatgtcggacggatgctgtcatggattgagatcatcttcaacactgtcagtgataaatggcatgcaatcggtcgacgtgcgctgaaaaatttgatcctccacaacaaagaacacacttacctgctggagcggtcggttgagatgtgctatgtgacagagcggcccaagtcccttgagagctactttgaagtagttaccgagattttgattgaacacaccgactatccgttgggcttctggagaattctgggcgctgtcctagtcactctgggcagccctaagcgagaaatcagaatgaaatcggccaagctccttcgaatccttgaggagcgtgagcagaagaactcccggttacaagattttgatattagtatatccgacaagacaaccgcggtctacaagctggcccagttcgaaacatcgaaacgtcttgcccagcagcatgctgacctggcatttacactcttctcagagttttcccagcatttcaagaacttgcggcctgacagtcagcgaaacttggtggcggcaattctcccttgggtacagacaatggaactgcaggttgatcccaacggtggccccacagccaagtcctacatgctccttgccaacctcttcgagattaccatccggtcaagtacgatactcccgaatgaggtccaagctttatggcaggcgcttgccacagggcctcatggaggaaatgtgcagttggtgctggacttcgttatcagcctatgcctcgaacgtaaagaacaaaactttgtggagtatgcgaagcaagtggttgtatttctgtcagggacgcctgcaggttcgaaggtgatcgagttctttttgatgcaagttggtcccaagaacatggtccatgaacgaaaagacattacgccggcaccgctagacgtgaagagtttaccatacgttgcggacctcgcaactgtgctccctgttggtaacaagcaagccgggttgtcccttggtcaggttgctcttattttccttgtcgacctcatggttgctccagtcacccttccacttccggatgtcgtgaagctgttgcatgttgtcgttattctttgggaccactatactcttactgtgcaagagcaggctagagagatgcttgttcatctcattcacgagctcattgccgccaagatcgaagatgatgaacccgcagggagccggcaatctatcgaggactttgtggagtgcattcgcagaagcgaccctaaagtagtttgggagtatgaggacagtcacgataaagaggatggcgaggatgacagccgtgtcccatcttcaatggctagcgttactcacgccgttgttgattttttcagtcttgcttacgagggaatcaccgatctatgggcaaaagaagcattgaactgggcgacttcatgcccagtacggcatctcgcctgccgttctttccaagttttccgctgcatttcgacaagcttggactccagaatgcttgctgacatgctggctcgactctcaaatacaattgcggacgaggaggcagattatagaactttctctatggaaattctcacgacgctcaaaatcatcattagttctcgagcacctgcagacctgctgcgatatccgcagcttttctggacgacatgtgcctgtctgaacactatccacgagacggagtttgttgagagtgttggcatgctagagaagtttttggacagggtcgacatgagtgacccgatcgtagtcggggagcttgtcaagggccagccaccgaagtgggagggcggttttgatggcatccagaacttggtctacaaagggctaaaaagttctcaatcgctcaaccgcacgctggatattttacatcgcttgagcggccttcccaacaatgagctcattggcgacggcaaccggcttttgtttgctatcctggccaatctatcccatttccttcgccagttcgatccaaacatcgatgatccaaaaacactcgcccgtgccacgttattggcgcgcgtggccgagggtgagggatgcccgcgtcttgcagcttctctccttggcttcgccaatgggcagtacaaggcggagaatgatttcttaagtcacatcatcaccgaaatacgatcctattactatccccaacaggattttcaaagcctagtcttcctcatgggcttgctcacgaacgcgacagattggttccgtgttaaggtcatgaaaatacagtgtgcagtgattcccgaagttgacatgcggcgatctgatgtggcaagtcatggccctgatttgatatcgccccttttacgccttctacagaccgatctttgccctcaagctctgcaagttatggaccatatcatgaccgtttcgggcaatcctatggagcgccatcatattcggatgagcatggcttcatcgacttcatcgagggcaatccggaaagaatacgagcgaatccagagtctttacgggatcccagaacctacggggtggtctatcccgatgccggcggcccagtcagctgttacacgacataatgtccacgcggtattctacacatgtgctgaagttgatcgggtagatgcgcaggaacctgtaccgtccgaggttgagttccacgctgacgattacaatgacaattttttcccaatgcgagccgatacgatgcaatcgattgagacgcagacggatggcaacattggggatattgtgcagaaactggatagtctggacgacttcttcgaggacacagaatcatcccatccgacgcttgatgctgtgcctgatatgtcattacgtggtttcgcaggcggttacgtggattccaacgcaagtatctatgaccagcaaaccgccccgatactgcgaaagtcgctcgcgcggacagcctcaacatcctcatttcataatggtctcgttgactctcgccctacaaatatgcgctttgacggtgttggctatcataccgccggcacatcgacacctcatctatccacccaaacgctacgtccagtatctcatacacgttctgtgacctcaccggtcaatcacgtcttttctcaaagctcggctggtccgcagttctctactccacccactggagttcatgagcccacctttttctctgacgatgaaatggaggatggctcattcgactttgatggacgcctaatggtgaacaagcaccctgcgcaccctttgaccagccaatcacgcagcgcaacggacggctcgtcgtcgctcgaatcgatgatccgaagtggcatgagacgactcaccggaagcacagcagctggtcgagataaagagcggcagcgtgaatttgtccgagctcagcaccgagcgatggctcagactgtggattcaccacgtgtgccgaaggtgccggcggaataccttggaggatctccaagtcatccaagttcaccgggccagtaa

SEQ ID NO: 448 - DNA, 7734 bp, Aspergillus fumigatus
atgcccctcatccctgacgattcaagtctcgcgtcgcaccataatatttcctccccaccagaacgcctggttacaaggagtactcctgcgtccgccattcatagtcgagaagcctccgctgtgaggggaagagcagccgatccatccgctctagccccctcgacgctacagcctcagaataatcgtcgtggccaatctcattcgaaaagtcctgatccgactgctgcacgccccggtataggatacgatgtaagcctcgaaagaaggccttcgaactcatacggtcaccaccgacagacttcgattgtccatggcgtccaacattctcgaaatccgagttttgctgcctcctccaactctacgagtcctctgagtccagagttgatcgcgtccctcggccgcggcgctggaaatgaacaggagataagtagtgcagggcggttggatcagaacgagatgccaacgattcatcatagccctggaggcaatgggacgagccatatcttgcaagggaccttgagtaccatcgaggatcaggatactggcgaggtcggcaacgcaaactcggcgagctcggtgcatagaaggatgaactcggctggaaaatcctggaaagagcgctctcatagccgctcacactcgagacaacaacactcggaatccaagactgtcggcgaatatgccttgcaccatctttttaattcattcgtcggtcaggcagacaacaaggtcaatcaagccattatgaagcttggacattcggatgctccggtagaagaggtttgcggtcctggcgtggatccgaacttcgatcaattgatctcagctttgggccacatctctcgacagaaaccaaagccgttgatcgacaccataatgctatggcgaaaagccaaaggagacgcagccataatggctaagcaagctagtcaaaagccgtctacctctgataatgtgcccatcgcgcgccgtaatacagagccgtcccagaacgttgttgattcggcagcaccaacagattctacgacgtccagcaccatcctaacacggcaagaagatgtcgtcttagctgagcgccgtgcgactgtgtccgtgtatcttgtttgcagagtcttgattgagatattcaaccagagcaatatagcatccataacgattgacatggctgagcgtttggaggacatcgtctttggtcaactcaagacggttgacccggatcagatatcagcgtcaccgcttcgcatggctaattggcggatctattcccagttgcttggtatcatgagcgagacgaacttcacgagtgtcactggtcgcttcttagcagaactcgaacgatatcagaaggaagaaatgctccgtgggccgtcaagggagggtgactctcgagcagaacttctgatcttgggaatgagacacattcgtatcaggacctattcggataactggagtaaatcatgcgacttcatgcgatcattggcacgcttgtttgccaatgctcacgggcagcgcgtcaaacaggcttactgttacattttcgagaaactcctcttgccagtagcagcgagttcgaattgcgatctcagcttacccaagtggaaagaatttctggatttggttcaatctcgcctatctcaaatgctcactaagccccgtcactgggccgctgcctttccacttcacgtactgctattgtgtgtgtcttcaaaggaggtgttcttgtctcaatggctctcggttattcagagtcttcctgcaaggctgaaagaccgtccaacaaggggcccggccctccaagctatgtgccgcctgttgtggacatacttctttcgctacacagactccccaaccgtgaccctccgaaaagttgaggaggttgccaggatagccttgccagctggtaaaaggtcgtacttgagtacagatcctgcagttgccgagcccctcatacagctggttcgcatgatcggcttcaaacaccccgatgtctgcttccgcaacatcatttttcccttgataaactctgacctttttctttccggaagagagctcaaaattgaacagatggagcccgagaaaatggtcatcggtatcagatcttttctggcgatagtgacggaccttgagaactgtgatcagctctgccctccatttcctactggctcaatccccaacccattcactgatatctctgctccgactcatttacatcgaccccagcttctcacagatccgcgcctgcccggttctatggagagtaaagatacagcactatcgttacctgtcaatacatccagactaagcgataatgtcaaggaatattatactcgtttttgtgatatccttggcaagatcactctgttatgcgacaacacattcggtggccaagcaacactagatgagaagttcggcgggacaactcctaagacaccaatctccgaggcgtttagcttcggaaggcgtgatgaccatccaagtattggggatcaaaggcagggtttctacgatttatttcatgtggcggtacaggcgctcccccgctgcttatcagatcgcatcccattcaactcgctaattaatttactttgtaccgggactgcacacgttcagtcgaacatagcttcttcttccgccgaatccttgaaggcaatcgcgcgacagtcgcacgctcaacaagtcactattggtttcgcgagatttattttcaactttgacgcaagatattccaccatgtcagacgaaggcatgctcggaccaggccacatcgagtccacgttgaggttgtacgtgcaattactgcagatctggatagaagaaatcaaacaaaagaccaaaggtgcaactacagatcccgtggacaaatcgggcactggaagtcgagctctgcagttggacctctctactgtcctcgcacacgttgaggagatcgagtctcatggccttttctttctttgctcccagtcgagacgggtccgtgcatttgcaatcactgtgcttcggctgatcacggagttcgaccgcgctcttggcaaagagaatacaagaattataagagtccttgaagctgacgcgcatgaaatcctgaacgtcaacgatgaacagctaagtgtggcggaaagaagccgaattcagaaggggaagaggaagagcgcttcccataacaccttgattgaattgtgcagcagcgaggtgtcttacgactcgactctatggtcaaaggtattcccgaacatcattaggatcagcttcgaaacctgcccgtttgctgtgactttgggacgagagatcgtctgtgcgaggctcgtccagatgcataaaactataactgctctcgctgatagtccgcatccacctccatatgcgcccattgatcctgctcaagctcgcgcactgggcagaagcaacatgactgcggaaatccttatagagcaatggaagctctatctagtcatggcttgtactacactcaacagcgtgggtgcgcagtctcaaagtcagctcgcaaatgcccaacatgcgcgcaaatcctctaagggatctcagcagtcgcaagataagatcagctccgccagaagcctctttgcttttgtgataccgttgttgtcggctgagcgatcctctatacgaaatgcaattgtgatggcacttggctctatcaataagaatctttatcgcacttttcttgagtctcttcaatacgccgtaacgacatgcaatgaggaagcgaaaattcgcatcggtgctcaccatcgatccccgagcagccccagacgaaatcggaaaacggatcgcctgaggacagaggtcacgcacgtatacaagttgacttcgcatttccttcgagaacccgaggtgtacaacgacgactggatcgtcaataatctcgtcacttatacaaaggatctgcgcatctttctaagtgacgctgaagtgcagaatgactgggaattccaacgcctacggttccattactgtggcttgatggaagaattattcgagggaattaatcggaccaaagacccgtctcactggatccctttcgagtcacgaaaatcggctttctcgctaatggaagactggtgcgggtactcgcctaatcaagcacagattgctcaaagagaagagaatatgcgaaagttcgccatggcccatcaatctgaatctggggagtttcggaacacagcagctgcaatggagatcgagaagaagaatcttcgcgcagcggctcttagtgcaatggcctcattatgtgctggaccaatcagtatcactacggaaagtggctcagtgcttcaattcgatgtgggaagaatgctctcttggattgatatcattttcaacaccctcagcgataagtggcacgcgatcggtagacgagcgctcaagaacctgataatccacaacaaagagcattcttatctactggagagagcaatcgagatgtgtcacgtctcggaaaggccgaaggcgctggaaagttactttgaggtggtgactcaagtactgatagaacataccgattatccacttggcttctggagaatcctgggcgctgtactcgtcacgctgggaaatcagaagcgcgagatccgaatgaaatctgccaaacttcttcgcatattagaagaacgtcagcaaaagagttcaagacttcaggacttcgacatcagcatctctgataagaccacagctgtatacaagctcgctcaattcgaaacatcccggcggctagcgaaacagcactctgatttggccttcaccttgttctcagagttctcactacatttccggaatgtgggccctgatagccagcgaaatatggtggccgcaattttaccttgggttcaaaccatggagctgcaaattgatcctaatggtggtccaacagctaagtcctacatgcttctggccaatttgttcgagatcactatccgatgtggcaacatattaccgaacgaggtgcaagcgctctggcaggcactggcaacaggaccccatggtgggaacgtacagctagttctggatttcatcatcagtctctgcttagaacgcaaagagcagaatttcgtcgagtatgccaagcaagtcgtggtcttcttgtcagggacccctgcgggctcgaaagtcattgaattcttcttgatgcaggtcgtacccaagaacatggttcaagagaggaaggatattaccccagctccaccggatgtcaaaagcttaccctatgtggcggacctaggcaccgtgcttcccgtcggcaataaacaagctggcctttcgctaggtcaagtggcacttattttcctcgtagatctaatggttgcgccagtgacccttccattagaagccgttgtcaaactgcttcacgtcgtgctcattctatgggaccactacatgctcactgtacaagagcaagctagagagatgttggtccatcttatccacgagttgattgctgccaagatcgacgatgatgctcctgccgctacacgacagggcatcgaggacttcgttgaatctatacgggagagtgacccgaaggtcgtttgggagtacgaagacaataatgacaaagaggacggcgacgatggcagcagagtacctctctcgatgtccactgttactcgtcaggtcgtcaattttttcagcttcgcatacgagggtgtcagtgatctctgggccaaggaagcactcaactgggctacttcatgccctgtgcgacacctggcatgtcggtcattccaagtattccgctgcatatcaacgtcccttaacccgaggatgcttgcagacatgttggcccggctctcaaataccatcgcggatgaagaggcagattaccaaaccttttccatggaaattctaacaactctgaaaatcatcattagctctcttgcccccgctgacctgctgcgttatccccagttattctggactacttgtgcttgtctcaatactattcacgagacggaattcattgagagtattggaatgctggagaagttcctggacagtgtcgatatgagtgaccccgcagtagtcaccgagctcattcaaggtcagccacccaagtgggaaggcggctttgacgggctccaaaacctggtctacaaaggattgaaatcctcagaatccctcaatcgcaccctggatgtcctgcatcgactaagtggtcttccaaacaacgcgcttattgggaatagcgacagactgctttttacaatcctagcaaatatggctcattttctccaccaattcgacccagacgttgatgatccaaagactcttgcgcgtgctacgttgttggcgcgcgttgctgagggagaaggatgcccccgtctcgcagcgtctcttctcgggctcgccaacggacaatataagactgagaacgattttctaaatcacatcattgcagagatgcggtcttactacttccctcgtcaggacgttcagagcctgatttttctgatgggcctcctgacaaataccacgaaatggtttcgcgttaagatcatgaagattctctgcgtgttgatacctgagattgacatgcggcggcccgaggtgacctcgcatggacctgacctgatttctccgctcctacgacttctacagaccgaactttgccctcaagccttggaagtcatggatcacatcatgactgtttccggaaatcctatggagcgccatcacattcgaatgagtatggcctcatcgtcgtcctcgcgggccatccgcaaagaatacgagaagattcagagtctttatggcattcccgaacctactgggtggtccatacccatgcctgccacccaatcaagtgtcactcggcataatgttcacgctgtattctacacctgtgctgaggtggaccctatggaagtgcaagagactgttacaccggaagtcgaattccacgcggatgaatacaatgattcattcttccctatgcgtgccgataccatgaaatcaatggacacgcagatggacggcaacatgggagacattgtgcaaaaactagacagtctcgatgacttcttcgaggaaacagagcctattaactctggacttgatgtaatgccagacgcatcgttgcgaggctttactggtgcttatgcggacacgagcgcgcatctttatgaccaacagaccgcacccattttgcgcaaatcacttgcgcgaactgcatcaacctcgtcgttccacaatggcctcgctgaatcccgaccaccgaatcagcgctttgatagtgtgggtgtctattcaccgaatacgctgatgccccaggtatcaggtcacacgttgcggccgacaacacacgctcgctccgtcacctcaccagctaacaacctttatccgccaagctcctccaatgtacagttttccactccaccgcttgggttcagcgaatcagcatatttgtccgatgacgagtttgaagacgggctctatgagtttgatgagcgactgactaacaacaaaccgccgaccgttttccataatagtcagggccgaagtgtaacggatgggtcttcatcccttgagtcgatgattcgcagcggaatgagaagacttacaggcggcgcggccgcgaaccgggagaaagagcggcagcgtgacttgatcagggcccaacatcgtgcagctgtgcaaacggcgaactcaccccgggtgccgaaagtgccaccggaattcctcacagggccgaccagcaatccgacatcaccaggacagtga

SEQ ID NO: 449 - DNA, 2691 bp, Magnaporthe grisae 70-15; identical to SEQ ID NO: 31

SEQ ID NO: 450 - DNA, 2325 bp, Gibberella zeae PH-1
atggataaaacgccagctcccatatttcgaaagcagcgaggtcctgcacctccgtcctcagcgataccctcttcttctcccgcctttggcactcctgtccaccctcttaagccattcgccgttaacgcccccaaagctgcgatattacctataattctgcctccgccgacgttgcgacccctcgctttccgcacattcacaaaaaagcactccctcacactcacgtcttcagctctgcaggaactcgctgccttcattggcaggcactgcggctcaggatggcgcgaagagggtttggccgagagggtgctcgaggaagtcgcacgaagctggaagaatcgcaatggaggtgtcattgttgaagggtcgagtaaagagatgcaggaaattctcaagactctcgagggcaacatgagcggtggcaggattacggggccagcaagagggctgccacgaggagacagtatgctcgacctaaacgacaacgatgctttgaacacacgcttgggactccgaccagcagaagtgagaagagaagatagtaactccagctttggaatatcaggattgggtgtcgacgaggagcaagaggagacggagacgaacgatcctcgggcctggctcaagatcgtgaatgcttacgagcaacctagattcatatataacgtggccaagaagcatttcgaaaaggatccttcgcccccctcattgctacctccagcatcgcacaaaacgacagtcttccgcaaccgctaccatgtcatccaccaacgtcttctccgcaacgaatcctttcagtcttctactgtctcttcttctcgcaaacacaagctcgaccattctctatccaacaagcaattgctcaaactcacaccaatagccaatatgctaggtcgtcatggcagtagtcacatgttgttaggacttctggtcatccttcccaccggcgatctcgccatcagcgacttgacaggtaccattgcccttgatctctctcaggctgtggctatacctgaagactcggcatggttttgtcccggcatgattgtgctcgtagatggtgtctacgaagaggaagatgaatccgtgggcaagggtctcagtggtagcagtggtgttggaggtactctaggcggtcgcttccaaggctttttcattggccaacctccatgtgaacgacgcaaagccactcttggtatcagcggccccgatggcggccaggagcaaatcataggaggtggctttggctggatcgacttcttaggcgtcggcagtgagcgcgccttgggtaccaagatgcgcaaactagagagccgcctcctccgatctagagcagaagacgatgcgccatctcgtgggcgcgcagtcatcatcggcgagctgaatctcgaccagccccgaactcttcaagccttgcgcaaaattctttcgacatatgcctccgagcccgaaggatcagtacccttgacatttgtgctgatgggtaacttcactcagtatgccgtgctcgcacgcggaggtagtggtggaggtatcgaatacaaggaatactttgattccttggcttcaactcttagcgacttcccaacactacttcagtcgtctacgtttgtctttgtccctggcgacaacgatggctgggtctcttccttcacggcgggtgcttccgtaccgttgcctcgaaaacaagtaccagacatgttcacatctcgaattcgtcgtgtttttgcgacagctaataccgaagcgggaggaaagacaaatggcacggcggtatggacctcgaacccaagccgaataagtcttttcgggcccaaccacgagcttgttcttttcagggatgatgtatctgctcgtctacgccgagcctcagtccgtctcaagccgaaagccaatgatgctaatgcagacgagacgcaaagttcgaatcccaatcctcctgatgacgtccagcctatggatattgacgctgctcatcatggtgatccaactgccactgctgctgcatcacctgccagcccctttgttcctcacgacatacacgccgcccagaagttggtgaaaactgtcctcgatcaaggttacctcgcgcctttccgtcaggtcatccgccctgttcactgggactatgcctcatctttacatatatacccgttacccactgctatggtgctacttgacacaaccgcaccaccgttttgtattacctacgaaggctgccacgttatgaaccctggcagtgtccttgtaccaggtcgcaagggcgttgctcggtgggcagagtatgaggttggccgtgaaggaataagggtgctcgtggattaa

SEQ ID NO: 451 - DNA, 999 bp, Magnaporthe grisae 70-15; identical to SEQ ID NO: 11

SEQ ID NO: 452 - DNA, 3375 bp, Magnaporthe grisae 70-15
atggagcaaccgttgttccgcaactcgtcctcggcgcggactgagttgtttgccaaggtcggtaggcccatcatcagcaagcttgtgatgcggccgtccgcggcaccatcgcaagccaaccagttgctgcagttgacggatcgactctactccatccttaatggacaggtcagctatgacgcctcggctgtggatgcaaagattgcagaatatgttttcttcccgctgtcgttcgtcttcaagaataaggaggatcactctgcccgagtgctagaaaacgccatcaagtgtctgcggattttgattcagtatggctggcgatctaccatctctacgagtctgactcaacagctactcatacttctcacattcatcatcgccggcgttcctggccagcagaggacttcgccgccgccggaagagacggtccttgaatgctacaggtctcttgctgtcttgatcagagaggcatgtctgtcaagctccgtatcagaatccctggttgactccagtggtctaccaagtctaggccacaccgtaactgtcattttggatggcagcacggatggaatgactgcagatatccagcttgcggcactcgatgccctgaggactctctttgtctcgatgaaagaccgtgctgcacttgcatccttcctcccaggcagtgtgtcgactctgtccaaacttctctcgccacctgcgtcactcaagcttcagaaacgtgtgctctgttacggagcaagagtctttggggacgttctgaccagggtgctaggcgacatacacaatagagatgcgctgaggcagctcacctcagacacgaccggggagggaaaagacggcgagctgtctgggacagagctatctgcgtcttggctcaaagctacatccgctcaagtcaggatggcgctcgccatggtgctcaagttacgatcccacgagtcggataatgttcggaatgccgttgagaggcttgctctatccctcttagacgaatgtcatgcgtctttggctgactgcacagtatttctcgtcgagacggccatttttacctggaaagaagaagatgattcaactgatctatcggggggtccaaagcataccgcttcaagcattcgtgactctgctctgccagaaagcgtagcggttcaaactaccttgcaggacctggccatgatatacccggaacttcaagatgctatcaagaccgtggtacataatatgattaccagcatgcccagaatcatgcaaacttcagacgaaaaaattaagcagcagtgcatatttgcactctctcgagggcagcgaatagtgaaagtcctgaatattgactcgtccctgttgcatgaagcactgtcctcggctctgagagacagcattgtggctttgacctcaagcaaaaaacaactgaacgtcgtggccgacgctgaatttgaaggggagatgagtgtcaaccccacagacttggttacacggccgggtgaaacgcgaacattcaagcccatcatgctggcgcatgggagtcaagcaggtacacgtgatgccttcctcaggttggtttccggtattggctcgccatctcagcaggcagatctggctaccgacatgatcagtctggcaagggatttgtcaggaatagatcaggtcacagccttatggctagcgtttgagttgctgaaagtagcactagccaagaacgagcaggacgagcagttctttgacttttccggcaccatgtcaacaaatgagcctaccgaagtcttccaagagctctatcagctctctgtcttgatgctgacatcacatactgacagtctcgaagtcgactggagactggaggccatagctattgaggttacgacttttgccgcctctcaaatgggggtttcattcaggccagagctcattgatactctctaccctatagcaacctacctgggctcacaaaatacccagctaaggcttcacgcgatgacagcgcttggcttgattgcgtcagcgtgtggatatcaggatgtgtccgagttgattgttgacaatgccgattacatggtcaactcggtatctctgcgcctgacttcgatggatgttacaccggcgtcactccaagtactgaggatgatggtgaggctgacggggccgaagctgttgcctttcctagacgacacagtagccgccatttttgctgctcttgataattatcatgggtaccccgccttcgtcgagcgattgttttctgtactctcagaggtggtgcagcagggtgtcaagtctgacgtgctcttgcttgaatcgaaggaatccaaaagtcttgaccacaggaaaagatcaatggcagcagcaaccatcaatgatattgaatcagaagtgaaagagaggattgcaaagaaacagaagaggagaaaggagaaagaggatcttcttccaggcgttagagccaaacatcctcagaagccgtggacttctgaagcaaaacagcttctagacgaaagggagaggaagatgaaagccgatgatgaggagaaagcagaagacacagggtcaggcggtgaggtcgagaaaccaaagccggtccgtacgccaacatatgaactgctgtcacgagttacgaccttgacgcaatattatttaacatcaccaactccgactttgcgaaaatcgttactggatcttctctctacaattactccatctatggccctggatgaggatgcatttctacccatggtcaactctctttggccggtcgtcatctcgcgccttcgcgacggggagccatttgttgtggctgcagcttgcagagccattgcggcgcttgcacaagggtctggggacttcctggcctcgaggatcaagactgagtggtgggactcgatgtccaggtggtgccaaaaggcaaagcagaatgccaagactggtgcgacaggaaatggtgggagaagtggaaagagcaacaattctgttcccattcactccggtcgaaatataggcagactcaacatggccttggttggcaatgaagttgtgctgccacaccgtccacagggcagtagtagacctggcagcggcggtgttgatactgaaaagtattcagacggcggactgggaaggtttgcgcaggcatcacaagtatgggaggccaccgtcgacatgctcgttgcactggtctcctttgtcaggctggatgacgaggtttttgaccaaatactggaactgctcgccgacgagctcgagagcaattcagttgctcgcaaagcactcgaggtggtcaatgcggatgcggtttggctggctagatttgaacgtggctcgctgacacaagatctcagtgtaccagtcatggacggaatcaggtttgctgctttggcataa

SEQ ID NO: 453 - DNA, 5001 bp, Magnaporthe grisae 70-15
atgtccgaagcctatcttttagagacactgcagtccttctatggcgatctaatcgcaataggcgaggggcgcctcaatggcccgtctctggagggagacgagctgacggctctcctcgaaaacttcaagaactttcttgaggagccaccaaagcgagacgctagccgaaaacaacttgagtccggcaagattagcgtgggagacgtagaatactcgatcaacaaggagttccaggaatatagcatacaactcgcagacgaggtaaacctggatgaggtcgaggcggccaagctgctcctcgaggcacaagatagccagatcctcctgggaaggtcgctagtcgagtgcgcgctcattcggttccaccaacgacgaaaatacctcctagattgtatacgactatgtatcgagcttgcgaatgacgacgagaacgaatcgatcaaggcggtcttcgaagaaattgttgcacgatatgtttttgacctgccattgccaggtgctccggccgcggcggttccgaaggaaaagaaagtagtgccacggtgtatggcagcaatggccaagatcaaagactggctcgaaaaactggccaacaagatcatgctggcaagaatgcacagcggcacggctcctcctgagatcgagaccatcgagttttgccgcttgagtctagtgcagcaacacgagaacttggccgtcatcctatgcgctgcggttgagcaacgtcatgcagaacgcacaaactttgaagagttcatccaactgctgaagaaggccgataaatacgaccacctcttagtgcatcttttccccgtcattggagcctatattcgtctgtatggatcgactgagggctggggggatctggttattgccaggtctttgaaccaaaaaattgtcaacgacgagacgtcttggtccttgccgtttctgtatgccgctgttaaggtctggtggattgcagagtacagcggcttctacgtcgagggtcctgtttcggatcccagcattgacattgacaaagaggataaggagagaaataagcagttcaccgacgctctcaaggagggagcattcgacttcatgttgtcacttgcaggggatgttgctgcccctgaatggcaagacccctctcgtattggaatcaggcaatggctccagcgaaagtcaccacaactgatgactgattcaacgccattctccgactacttccacacgtgcttgatgaaccagcttgaagattttgtggatgcttttatatcaaatcttcccgatgttcttcggaaacttaggaccgaggaggacgaacaacggcagcttagccagcaccatgaacaagacttggatctggaaagattcctggtcatcatctcttacgtctttgaaagacggcccgacgcagctgacgtgttctggtcggactctgaaagcaacttggcaggtttcatgcagtgggcatccaggagagcatccacgccgctcgtgtgtgctttctgcgagatgctgcagtccatcactgagaatgaacagtacgcacttgctgctcaccagttcttgttggaggacagcaatgccggagggaaaatgagaagatcacagtccttgacatgggctcagattttcaaagagttgcactacttcaccaagaaaattcgtggtgaaatctctagcccacagcaaattcacgaataccgaacgcaaaagccaggcgaggacctagcagaaacggaaccggagtcggctatgctgctggagtgctatctccgattgatcgcccgacttggaagtcagagcacagcggcaagggagttcctactcaggaaccaagacttccccttggtagatgtgattctgcagctgaacagctgccacatacctcctaggctgcgtgcctgtggcttctatgccattgcggcactagtcaggcgcaaagaacaagacgacagcaataccatgtggctttgcatagacgcctttgttagtggcggctttcaagccgcgagcaactcccgtggattgattaagggacaaagccacagctcagccggcgttgttgatagggtattggacgagctgagcaacggtttcgaggaaccaagtgcttttatcaacctgatcaacgctttagtcgcgccagcagatcaagcaagtctcctgcgagatgcccttcctttccccgagaaccttgggtctagcttacgaatgccggggattgagccatacgttgactttgttgtgggacatgtcttcagcctcaagtcaaaagagctccaggatgtttcgcagctgagagttctgcgagtgagctgtttggagtttatcttgctgtgcctaaacacgttcaacgaagatcttatcattcttggtaatcagaccaatgtctctgtggacttgatcattgccacatcagacctggccacatatgtccgccttcacccattcgctcgggtgatggaatggatgttcaacggccaggttgtagatgccatatttgaaacgatacaccaacagtccagcgatatcggaagcgtttcgcccgattcgcccttgatattgggcattatacgagctgttgaggtggtgtcgaaagttttggagcttcaggacacatatgttgatcttgtgcggcaagtcataaaacagcacacaggacaacgccatagacatgtgcctcacgcttcctacgcctccttcgaagaagggtttgctcatcacctcgaggtcgtcgcagatctcggccgatattgcggcctcggtcacccagagctgaccatggtctgcttaaagcttctggcacggatttccacttcatcgaaactgatatcggcgtggaacaccgagccaggtagacagtcccaccgcaacaaggcggtagtggctctagaaaaagatggggaagcggattctatttccggatccctcattgccgagcttatcgtgccccttgacctggctcgagaggctgactctccaaactacctaatcaagacttacattctagacttcctctacgcatgtttacgagcatctccagaccaaccaactatcgcccatcttctactcggcttcaagtgcggcgtgagccatttgaaagtcgagcccagaggccagttcgaggaaaggacgtcgctatttcacaatcttctcagggtattgctggagactccttttggagacgaggagctaggaatgaggacatggcttgtggcattaaagcgcaaagttatggggatactgcagattctttggagttctcctctgtcctcggccattgtcttggaagaactccggagcaacgacgttctattccatattctgctccgcgaggagtcaatacagcctgatctgatgtgggatggagtgagcatggaggaacgcggattcctactctctgacgcagccgtgggtttttcggagttcctggctacgaggcaacttaccttcgattatctggccatcgagttatgcagcgtcacccagaggcgcctccccagcttgaaacgccgtatctatgacgcccttaacggacaggtcactactgccaattcggacagccctcaatccatacccaccatcttcgatttgtacgattttatgcctgcggacgggcaatgggagatccctctacctgagttcacccatttcaaaggcgaagaattcagtatgtgcctggaaggagcacatgactctgtgctcatgtacaacatggagcgggtaaaacaggtgattgcattgaagaggaggcaggatgctcaaaatggtcagatagctacggctgccgacctcgcttccgtggaccgggagcaggttattcttgaggaatacttggtctaccacaaccgccaagcagcagtcagttctgagcgacggaaagtgctcaaagcctgggttaatctgctcatggtgatgttcgaggcgagcgatcaccagggctcagcgaaggttgctttccttttacaagcattgcagacgatattaccaactcttgagtctttcggatccgaacgtccgggtgaggcatttgagctggcgaaactggcaaaagttctcctcttcaagctcgacatagccgctccagacgcagaggacaaggacgcacataccgtgggcaacctcatcagcgagaagctcttccagttgtttgaggtttgcctgtacgccataggtaggcgaacgggcagtgcggaacttcgatccacgtactatgccatctgctaccggtatctgataggtatcattgacgatggaagagatttcgtgcctggccgcaggaaagcgatcaaggctgttcaggtctacggcgagcgcctgttgaccatcgtctgcgacgatgcatttggcggcgatgcaacgtgccaaacttctgcgttgatcttgctaggcgctttgacgaacctgggtcgacgagaggacgacggtcaagtggtggaggctctcaatcgcctgaactttattggcgtcctcgttgactctttgaagacaatcctcgatgatgtgactgcggcccgtaaagcaggaaactcggaccagcaagaatcttactcgcacgcaaaattggcgcttctccttcagctctgccaaacccgcgatggagcaaagtatgtgctgcaggctaacctcctgcgcgcaattgaggtctctgggctttttgcggcagacccagagctccagattgatcggagcgacactaaagccttggcggaccattatgacctcctaataagggtgatgcgtgtcatcggtgcggcaatactgagtcgcggcgcgcacaacgtcccgcaaggtcgccggttcctgaccgagcaccgcatgcttgtaatgcacgtcctcaagcgatccgctggcatcgcagccgtcgaccagaagctggaggcgctagttgttggactcgcggattccttcatggtgctgattactgccacagagtttttggagtttgaggatactcaagggcggggtccgcaacagcaaaagaagactggcccagtcctgtttcattga

SEQ ID NO: 454 - DNA, 4929 bp, Gibberella zeae PH-1
atggccgagatcaccgctttagatgccctccaagctttccaccaagggcttctatcattacgcgaaggtcgcgtcgagggtgcagagacactggggaatgagttcctagtccaagttttcgagaccgagttggccaagttctgggataagccggcaaggaaaagcgacaatagaaacgctgtcaagtctggcaaagttgtcatcgacggtgacgaatactcgatcaacgataacttccaacaagatgtccttaccttttccgacgaagtagagctcgacgagcttgaatctacacgatgtttactggagtcgcaagaagaccctaatacgctaggccgatcgctcctcgagtgcgccatcatccgatttcaccaacagcgaaagtacgttctcgatattgtgcgacttctcctcgaactagaaggcctcgacgacgatattgccgatgcggaagcccttgaaagtgtcaaactgtgtatggcttccatgagggagatcaaggcgtggcttcagaagataggagacaagatcgctgcggctcagaccctcggtcaaactacaactaacggcgtctctgagcagatagagaccatcgagttctccagagttagcttgatgcaacagcacgaattgttgggtgtaatactgtgccggagtattgaaatgagacaaggatcaacccaagactttctcgacttcgtatctgtccttcaaaaggtagacagatatgatgccttgctggttcaccttgttccatctatcggagcatacatctcagttttcgggtctgctgaaggcggatatgatcttatcaaggcccgtgagttacacggcaagctcttccctacggacagttctccgtggcccttgtcacagttgcaggccgctttcagggcttggtggcttgcagagtacagtggcttctacgtcgatgacccccctgaggcagcaatcccccccaacactgacttggatgaggaggatcgacagcgatcaaaagcgttcctggagtctctaaaggacggttctttcgacttcctgctctcaatcgcggccgatgttaaatcgccggattggcacgaccctgtaagagccggtatgcgcaagtggctgcaacgaaagtcacctgctctcgcccccgatgcaatccctttcgccgatttcttccagatgagtcttatgctacagctcgaggtgtttgttgacggcttcatctccaaccttcccgacgtgctacgaaagcttcgcgtggaggaggacgaacaacgtcagtctagtcagacacatgaacaggatttagaccttgaaagattcttgctgatcattgcatatgcttacgagggccggcccgatgctgccatgaacttctggtctgaccccgacagtaacctggctggttttatgcactgggcctctcgcagggcgtcgacgcctctagtgactgcgttctgcgagatgctccaggctatctcggagaatgaagagtgcgcttctgctgcacatgagttcttaattgacgagggtcaccattcatctgggaagatgagaaaatcacagtcattaacatgggctcagatcttcaaggagctggactttttctctgccaaaatcaggcagaagccggcgccacctcaggcgatacgttatcgtaatgagaagatgagtagtgatcaagcagaaaccgaaccggagtcggccatgatgcttgaatgttaccttcgtctgatgtcaaagttggctagtgaaagtgagacaacacgccaatttctccttcagaaccccaactatagccttgtcgaaacattgcttgagcttgctagcagcaacattccaccccggttacgcggctgtacttttatggctctccgagctttgatggcacgcaagtcgctgcaggagggtgctcttatgtggaattgccttgatcaatggatcactggagagtatttcctccacccagttacttctcatcgtcaatcgcaacagtcgcctagtgtcttcatggagcgtatttttgatgagattagcaatggatttgaagaccccgaatcctttatccagctcctgctttccctcatatccccagctgcggacagcagtcccctcaacgacgggctaccatttccagaaaaccttggctcctcctctcgaatgcccggtattgagatttacgtcgactttgtgatagggttagtctttgcccaaaaggccaacgaccttcaagatgtcaaccaaactcgggtcttgcgtcttagctgcctcgaattcatccttatctgcctgaacactttcaacgaagatcttatcatcatggcaaatgaaacgaatatcaacgtcgacagcgtcattgcaactaccgacttggcgacctatgtacgaatgcatccttttgcgagagtgatggaatggatgttcaacgacaaagttatggcagctcttttcaacactattcaccaagagcctgcagatgtgggaaatgcttcccccgactctcctctaattcttggcatcttgcgcgctgtcgaagttatcagcaaggtccttgatctccaagctacctatcttgagcttgttcggcccattattaagcttcagtcaaaccagcgtcgaccacccgtggcaaatgctgcattcgcttcatttgaggatggcctagttacgcgactgaacctcgttgttgatttaggtaactactgtggtatcgggcacccagaattgacgcttgcgtgcctaaagcttctcgaaaagatgtcatcatcttcaaagatcaccgctgtttggtcagggtccagtcgacaaatgcaccgcaacaaggctatcgttgctctagaggcgaatggcgagcacgagacaatctcaagatcgtttgtctcggaattgataacccctctggagacagggcgtgagacagactccccagcttatgtgaccaaaatctacattctcgacttcctataccaatgtctacaagaaacgccccgcaagcctacaattgcccatctgctgcttggttttaagtgtggcattgactctctttctgtcgaagccaagggtgctttcacttcaagaacctctcttttccacacaatactgagattgctacttgagaccccctccggtgatgcccagggaatgcgacagtggcttattgccattaagtcacgcgtaatgcgtatcttgcatattctttggagctctcccctgtccgcccctgtggtggttgaggagcttcgcgaaaatgagattctcttccaccttttgcttcgtgagacagtcatcaatcctgacttgccttgggagggtgaaaacgtcgctctggtccagttccctgtcacagacggcgctatagctttgattgattttttgtctcttcgaagcatgagcctggaatacatcgcgatggaactttgcagcatagcccaaaatcgcatgccgagcgtcaagcgtcgcatatttgaagccttgaatggtcagatcattggggaaggagatactcctatcccaattcctacaatctttgacctgtatgacttcttactcccggaaggtgtctgggaaattccattacctcctctccaatattataaagatcttgacctgacagcctgcttggagaatgatactgacggcaaccaaatctacaacctggaacgcgtcaaggaagttcttctactaaaacgcggcgaggctcacgatgcgggaacactagttgcagcccaggatcttgttgcattcgaacgggaagagagcatgataatagagtacctcatttcctctaatcgacagaagcagctgacgacacaaagcctcaaggtcctcaagacatggaccaagctgcttttggtcatgatcgagtcaaatgacttcaaaggctcggcacagatttccttcttcctacaggctttgcaatcgattctgcccagtttggaagcgtttgcttctgagcgaccagatgaggcctttgagctcgcaaaattatccaagattctactcttcaagctcgatctttcggcgtcggcggatgacaagcaaggctcagccattggcaatctgatcagcgacaagcttttccagcttttccagatctgtctgcaagccattggcaagtgggctggtacgccagagctaaggtccatctactacagcatctgctaccgctacttgactggcatggctgaccaagggccactcacgtctaaccggcccaagaccatcaagaccatccaagtgtatggtgagcggttactcaatgttatttgtgatgatgcatacggcggcgaagcgcagtgtcagacagcggcgctcatcctcctcaacgcattaattagcatgggtcaccaggagagtgagggttatgttgtcgagactctcaatcgactcaactttatcggaatcatggtcgactcgctgcgaaatatcatgcaagagtggcaagaagtattcacgtcaggcacttctgagcagcagaattatcaaaacgcacgtcttgctcttctccttgaacttgctcaaactcgttccggggccaagtatatccttcattccaatcttttccgtgctcttgagatctctggcctcttcggggcagaccctgagctgcaaatcaacagcacgaacccgcgcgccctcgagcaacattacgatctcctcgcccaagttgtgcgcatcgtaagcgccgcacttgttgcccgtggcagccacaatgttgttcaaggccgccggttcctcaccgaccatcgcatgctcgtcacacatacacttaagcgcagcgctggcatcggaagcgccaacgctgatgaaggcctggaccagaagattgaagagttggctgaagggttaatggttatcattgcagcaacacgattccttgagtttgagaacgagggcctccctgagtctacgcagcagagccatgggcttttccactag

SEQ ID NO: 455 - DNA, 3222 bp, Magnaporthe grisae 70-15; identical to SEQ ID NO: 15

SEQ ID NO: 456 - DNA, 3174 bp, Gibberella zeae PH-1
atgcctcctccgccgcaccaaaagcccgagaatgttctcaagagggcccatgaactcatcggtgtcggtcaggcctccgctgccttgaccctgctacatgagcacatcaccaacaagcgatcccgaaatgtccccatcatgtcgctggagcccgtgatgctcctcctcgtcgagctctccgtcgaacagaagaagggcaagcttgccaaggatgctctataccaatacaagaatatttcccaaaacacaaatattgctaccatcgagttggtcttgaagaagttcatcgagctcgccgttgagaaggtcactgccgcccagcaaaaggccgacgaagttcaggagagcattgacgctacagccggcacctccaacatcgacgatctcgaggccactgagaccccagagtctattctccttgctaccgtctctggcgagcagtcccgagaccgcactgaccgagccatcgtcacaccttggctcaagttcctctgggaggcctaccgaactgtcctcgacatcctccgaaacaacgctcgtctcgagattctttaccagagcaccgctacccaggccttcgacttctgcctcaagtacacccgcaagaccgagttccgccgtctttgcgagctgctccgcaaccatgtccagaccgccgccaagtactcttctcagatgcacgccatcaacctgagcgaccccgacactctgcagcgacatctcgagactcgtttccagcagcttaacgtcgctgttgaacttgagctctggcaggaggctttccgcagtgttgaggatgtccacactcttcttaacctcagcaagcgacctcctaagaatgtcatgatggcaaactactacgagaaattgactcgaattttccttgtgggaggcaaccatctgttccacgccgctgcttggtccaagtactacactctcctccgccagtcctctattttggtcgccagcggccagggcaagaagtctgataacccacctgtgtccgatgccgagcttcagaaggccgcctcttttgttgtgctctctgctctggccatccccgttatcagcaccagccgatctcgcggtgccatggttgactttgatgaggctaggaagaacaagaactctcgcctgactcacctccttggcatgtctcaagctcctactcgtgccagactcttccgtgatgctctgtccaagtctctccttcagcgcgcccgtcccgagattcgtgagctctacgagattctcgaggttgacttccaccctctctccatttgcaagaagatctcccccattctgaccaagattggtgccgattctgagatggagaagtacatcctccctctccagcaggttatcctcacccgcctgttccagcagctctcccaggtctacgagactgttgacctttcttttgttgagagtctcgcccagttccccgagccctaccaggttactcgtggcaccatcgagaagttcatcatgaacggtaacaagaagggcgatctgtctgttcgcatggctcacgccactggcgtcttgagctttgacaacgacgtcttctcttcctccaaggccagccacagtggctcttctgctggctctgccgagtctgagactggcactgttcagcgtctccagagcaccccctctgagatcgtccgctcgcagcttacccgccttgccaagtctctttacaccacctgccattacgttgaccccaacttcaacaagaatcgcatcgaggctcgcgaggctgctctcgctcgcgccaaggctggtgccgaagaggagcacctcgctatcctctcacgaaaggaccttatccagaagcgcaaggaagttgcttctgagattcaggccaagaaggagaaggagaatgctcgccagaagagacttcgtgaccaggctctgcaggaggctgaggatctgcgactccaaaatgagcaaaaggagcgtgaggccaagcgacttaaggccgagcgtgaccgtgtccgtaaggaggagctcaagaagcagatcgccgatctcaagatgggtgacaaggctatcgatatcgatctggaggaccttgacaaccttgacagcaaccgcctacgtgctatgaagcttgcccagttggagcgtgagaagaacgacgttaacgagcgtctccgcatcactggtaagcgcctcgatcatcttgaacgtgctttccgtaaggaggaatccaagaagttgtccgaggattacgccaagcaaattgaggaagatcgcaagatctatgaccaaatgaagacccagaagcttcaggagtcggagcagaaacataaggagagcgttgagctcaagcaccgactcagccgactggtgcctcagtatgaggagttccgtgactctctgcatgagcgtcgccgtgacgagttcgagaagcgccgccgcgacgctgagcgagaacttgagaagcagatcacccaacgtaagaaggaggtccgcgaccgacgtctccgcgagaagcgtgagcgcgaggagaaggagcgtgagcttcaggaggccgaagaacgtgccgcccgcgagaaggaggagcagcgcatccgtgatgaggctcgcaaggaagagcttgctaagctcaaggaacagcgagagaaggagcgtcaagagactctcgagaaggctgcccttcagcaacgacgtgaagatgaagcattggcacgtcgcaaggccgagaaggcccaagcccctgccgctggcttctctcgtgcaccagagcgcacagagtcctctgaagccaggagacccatgtttggagctggcaagtggagagagcgtgaggctgcccgtgagggtggtgatgcacctccgcccgctcgagcacctcctgtcgagaggtccgattctaacgaccgaccctctgccagtggtcctcctagaatcgcccttgctggtaacaagcccagttggcgagagcgcgaggctgccaagcaggcggccggtggtagcggagccgatactggatcttccgcgcctccacctcgcttcgcgcccaggggtggtgcgccacctatggaccgaagcggctctggccgtggtgaggacgatcgaaagccatctcccgctccaccggcggaatctcagcctgcatcacgaacagctggcaagtgggttcctcctcacatgaggggtaaataa

SEQ ID NO: 457 - DNA, 3162 bp, Aspergillus nidulans FGSC A4
atgccgcctccgccgcatatcaaacctgaaaatgtcctgaaaagggcccaggaacttatcgccgtgggccaggctccggccgccctgaccgtcctccacgaacatgctacgtccaagcggacgcgcagcagcccgatcgcgtctctcgagccggtcatgctcctctttgttgagctgtgcgtcgatctccgcaaaggtaaggctgccaaggatggcctgtatcagtacaaaaacatcgctcagaactccaatgtgggaactatcgagatcgttctcaagaagttcatcgagcttgcggagaagaaggtgactgaggcccaggctaaggccgatgagattcagtcatccctcgagtcggccgctccctcgtccaacgttgaagatctggaagcaatcgagacccccgagactattctccttgctaccgtttctggtgagcagtcccgtgaccgaaccgaccgtgccgtggttaccccatggctcaagttcctgtgggagacgtaccgaactgttttggagatcctgaagaacaacgctcgcttggagatcatgtaccagaccaccgctctacaggctttccagttctgcttgaagtacacccgcaagaccgagttccgcagactctgcgaacttctccgcaaccatgttcagaacgccgccaagtactctgcccagatgcacgctattaacctcagcgacccggatactctgcagcgtcacttggacactaggttccagcagcttaacgttgccgtggagctggaactctggcaggaagctttccgcagcatcgaggatatccatactctcttgagcctcagcaagcgccccgctaagaacgttatgatggccaactactacgagaagctggctcgtattttccttgttagcgagaactatctattccacgctgctgcctggagccgttactacaacctcctccgtcaatccgccgtcacactttccaccaaccagggttccaagaaggaccacccttcagttaccgaggccgatatgacgaaggccgcttcctttgttcttctatctgccctggccatccccgtcatcagcacgtctcgctcgcggggcgcgctaattgacgtggacgaggtccgtaagaacaagaacactcgtctcactaacctgctcggaatgttgcaaagccccactcgtgctgtcctattcagagatgccctgaacaagggcttgctcaagcgtgtccgccccgagattcgtgaactttacaacattctggaagttgacttccaccccctgtctatctgtaagaaggtcacccccatcctcaagaagatcggtgatgatcccgagatggagaagtatgttgtccctctacagcaggtcatcctcacccgtctcttccagcagctctcgcaggtctacgagtcggttgagcttaagttcgtttacgaacttgctcagttccccgaccccttccagattactccttccatgattgaaaagttcatcatgaacggttgcaagaagggtgaccttgccattcgtgtcgaccacatctccggtgtcctcacctttgacaccgacgttttctcatccgccaaggctttgcactctggcagcgctgccggttccgcagaaagcgaactcggctcggtacagcgtctccagaacacccctgctgaaattgcccgcctgcagctcacccgtctggctaagacccttcacgtcacatgcatgtatgtcgacccgtcatacaacgactctcgtctccaagccaagcaggccgctcttactcgcgctgcggctggtgctgccaaggaacacgaggacactctcgaacgtcgtgtcatcattgagaagaagaaggaggctgctacagatgccctgcagcgcaagcaaaaggaggaggaaactcgcaagcgcatccgcacacagcaactccaggaggctgagaagcagcgacttgctgaagagcagcgtgagcgcgagctgaagcgcatcaaggatgagcaagaccgcatccgtcagcaggaactcaagaagcaacttgaagaactgaagagcggcgtcaagggtattgatctcaatgaaatcgacctggaggatctcgatgccaaccgcctccgtgccattaagcttgcgcagttagagaaggagaagaacgagcttactgagcgcgtccgggccactggcaagcgtattgatcacttggagcgtgctttccgtcgtgaggaactgaagcacattgctgaggattatgaagctcaaaagaaggttgatatggaaatttacgagcgccagaaggcccagactcttgccgaggccgaggccaagcataaggaagctgttgctctcaagcaccgtctcagccgccttattcctgtgttcagcagcttccgtaaggaagtttcagagaagcgtcacgaggagtttgagaagcgtcgcaaggccgccgagagagagtttgaagccaagaagaagcagcgcgtcaaggaagttcaagaacgcagacgccgcgagaaaatcgagcgcgaaaacgccgagcgtgccaagagggaggaagaagagcgcatcaagcgcgaggaggaggaacgtgctgctagagatgcagagcgccgccgcatcctggccgaagagaaggccaaacgtgaggaagagagagcgtcagtaccacccaaagcacaaactcaatattccccaattaacttgtatcacagtaaaatggatgaaattgccgccaagcagagacagcgtgaggaggaagcagaagctcgcctccgcgccaagcgagctggcctctcagagcctccccgtacagagtctgaagtccgtactgctcctcgtcttaacattgctcctcgcactagcggtggccctagctggcgtgagcgtcaagccgctaaggaagccgccggtggcgctgcccctgaggcgcccaaggccgagcctgagcctccacgacgaactggcggctacgtgccccctcacgctcgcggtggctctgacgccgcccctcccgcgggcaaccgctacgtgccccccagccagcgctcctcccagccgccctcccgcacacaaaccccgccaacttcgtcccctaagcctgaagaacccaaacctcttgccagcggtaccggtgggaagtgggtgcctagatggaaacagcagcaacaaaaccagtag

SEQ ID NO: 458 - DNA, 3180 bp, Aspergillus fumigatus
atgtctgatggtccatcgcccaccatgccacctccaccccatatcaaaccggaaaatgtcctgaaacgggctcaggaacttatcgccgtgggccaggctcccgccgccctcaatgtcctccacgaacatgtcacctctaagaggacgcggagcagcccgatcgcctctctcgaacctgtcatgctccttttcgttgaattgtgtgtcgatcttcgcaaaggaaaggctgccaaggatggtctctaccagtacaagaacatcgcccagaacaccaacgtgggaaccatcgaggtcgtcctcaagaagttcatcgaactcgccgagaagaaggtgaccgaggcccaggccaaggccgacgagatccagtcctctctggagtccgctgccccatcgtccaacgtcgaggatctggaagcgatcgagacccccgagaccatcttgcttgctactgtttctggcgaacaatctcgcgaccgaaccgaccgcgctgttgtcactccgtggctcaagtttctctgggagacctaccgtaccgtcctggagatcttgaagaacaatgctcgccttgaggtcatgtaccagaccaccgccctgcaagccttccagttttgcctcaagtacacccgcaagaccgagttccgccgtctttgcgagctgctccgtaaccacgtccagaacgccgccaagtactccgctcagatgcacgctatcaacctcagcgatcccgacaccctgcagcgccatcttgacacccgcttccagcagctgaatgttgccgtggagctggagttgtggcaggaggctttccgcagcattgaagacattcacactcttctcagccttagcaagcgccccgccaagaacgtcatgatggctaattactacgaaaagcttgcacggatcttcctcgtcagcgagaactatcttttccatgccgccgcttggaaccgctactacaaccttctccgccagtccgccgctgcgctcgccgcaggccagggcaccaagaaggagaacccctcggtgaccgaggctgacatgaccaaggccgcttcctttgtccttctgtctgctctgtcgatccccgtcatcagcacctcccgctctcgaggcgccttggtcgatgtcgatgaggcccgcaagaacaagaatgcccgtctgaccaacctgctcggtatggctcagccacccagccgtgcggtgcttttccgggatgctcttaataagggcctgctcaagcgtgctcgtcctgaaattcgggatctctacaacatcctcgaggttgacttccaccctctttccatctgcaagaagatcacccccatcctcaagcaaatcggtgccgatcccgagatggagaagtacgtcctgcccctgcagcaggtcatcctcacccgtctcttccagcagctgtcccaggtttacgaatccgtcgagctcaagtttgtctacgagcttgcacagttccccgatcccttccagatcaccccggccatgatcgagaagttcatcatgaacggatgcaagaagggcgacctcgctatccgcgtcgaccatactgcaggtgttttgaccttcgacaccgatatcttctcttccgccaaggctctgcattccggcagcgccgccggttctgctgagagcgaggtcggctcggtgcagcgtcttcagaacacccctgctgaaatcgcccgcctgcagctcacccgtctcgccaagaccctgcacgtcacatgcatgtacgtcgatccttcttataacgaggcccgtatccaggccaagaaggctgcccaggcccgcgccgaggctggtgctgccaaggagcacgaggagacccttgcccgccgtgtcctcatcgagaagaagaaggaagctgccaccgatgctttgcagcgcaagcagagagaggaggagacccgcaagcgtattcgtaatcagcagctgcaagaggctgagaagcagagactgcttgacgagcagcgggaacgcgaaaagaagcgtctgagggatgaacaggagcgcatccgccagcaggagctcaagaagcagcttgaggagcttaagagtggtgtcaagggcatcgacatcagcgagattgacctggaggacctggatgccaaccggctgcgcgccatcaagcttgcccagctcgagaaggagaagaacgagctcaacgagcgcatccgcaccactgccaagcgtatcgatcacctggagcgtgctttccgtcgcgaggagttgaagcacattcccgaggactacgaagcccagaagaagcgtgacatggagctttacgaggccatcaaggccgagactctaaaggaagccgaggagaagcacaaggaggcggttgcccttaagcaccgtctcagccgccttgttcccgtcttctccagcttccgcaaggaggtgtcggagaagcgccacgaagagtttgagaagcgccgcaaggccgccgagcgggagtttgaggccaagaagaagcagcgtatcaaggaagttcaggagcgccgccgtcgcgagagggccgagcgtgaggcagaagagcgccgcagaaaggaggaagaagagcgggccaaacgcgaagaggaagaacgtatcgccaaggaagaggagcgcagacgcatcttggctgaagagaaagccaaacgtgaggaagagagaaagagactcgacgagattgctcagcggcagaagcagcgtgaggaggaagccgaggctcgccgtgcggctagaaagtctggcctcgcagaacctcccacccgtgctgctgagctcgagcggcccgttgagcggacagctcctcgccttaacctcgtttctcgtactggcagtggccctagctggagagagcgccaggctgccaaggaggctgccggcgctgcccctgcccctgccgccgcggaggcacctaaggaagaggtccagcttcctcgcagaaccggcggatacgtcccccctcacctccgctctggagccaacgcctcgcccgctactcctccctcgaatggtcctgcccccgagaaatacgttccccgtcacatgcgcgaatccagctcctcccaacccccctcccgcacacagactccccccgccgccgctcctgccagctccgacaagcctgaggcctcccccgcccctcagaaatgggttccccggtggaagcaacaacagcagtag

SEQ ID NO: 459 - protein, 265 aa, Magnaporthe grisae
MADAAPRGGGFASRGGDRGGDRGRGDRGRGRGRGRGRRGGKSDEKEWQPVTKLGRLVKAGKIKSMEEIYLHSLPIKEYQIVDFFLPKLKDEVMKIKPVQKQTRAGQRTRFKAIVIIGDSEGHVGLGIKTSKEVATAIRAAIIIAKLSVIPVRRGYWGTNLGTPHSLPVKESGKCGSVTVRLIPAPRGTALVASPAVKRLLQLAGIEDAYTSSSGSTKTLENTLKATFSAVSNTYGFLTPNLWKETKLIRSPLEEFADTLRDGKRY

SEQ ID NO: 460 - DNA, 1461 bp, Magnaporthe grisae
atgccgagagaaatcattacgatccaggctggccaatgtggcaacagcattgggagtcagttctggcagcagctttgtcaagagcacggaatcaatcaagatggtaacctggaagactttgcgaccgagggcggcgatcggaaggacgtcttctactaccaaagcgacgacaccaggtatattcccagggcaatattgattgatctggaaccccgggttatcaacggcatacaaacgggtccctataaaaacatatacaacccagagaacttctatgtcggcaaaaatggtgtaggcgcggccaacaactggggtgatggctatcagactggcgagtcggttcacgaagacattatggagatgattgatagggaagcagatggaagcgactcactcgagggctttatgatgctgcattcgattgctggtggcacaggctcaggtctgggctcattcctcttggaaaggctaaatgaccgatttcccaagaagatcatacaaacgtattcggtatttccggatacccagaatgccggagacgtcgtcgtccatccctacaacagcatcctagccatgaggagattgacacagaatgccgactcggtggtggtgctggataacggcgctctctcacatattgcagccgatagactccacgtgcaagagccgtcttttcagcagacaaatcaactggtctctactgttatgtctgccagcacaacgacactgcgatacccaggctacatgcacaatgacctcgtcagcatattggcgtccttgatccctacgcccaaatgccacttcttgatgacatcatatactccttttacgggagatcaagtcgagcaggcaaagacggtgcgcaagacgacagttttggatgtcatgcgcaggttactgcagcccaagaaccgcatggtttcaacgatacccgggaagaagagttgttacatttcaattctcaatgtgattcaaggcgaagttgatccaaccgatgttcacaagtctttgctgcgcattcgtgaaaggaggttggcaacttttattccttggggaccggcgagtatccaggttgctttgaccaaaaggagcccatacataccaatgagccaccgtgtcagcggtctcatgttagccaaccacaccagcattgctacagtaaggaacacttttgttgtatttttgatcacagaattcatactgaccaagtgcgcccttaatgttctgcagcttttcaaaaggatcgtaaggcaatacgacgggatgcgcaagcgcaacgcattcatagaaggctacaagaagacacagccattctcggaaaaccttgatgagtttgacgaagcgcggcaagtggtcagcgaccttatcgcagagtacgaagctgccgaagatgccaactatttaaacccggatgccggtgagcctggcacctcggccgagacggatcggagaatggggtga

SEQ ID NO: 461 - protein, 486 aa, Magnaporthe grisae
MPREIITIQAGQCGNSIGSQFWQQLCQEHGINQDGNLEDFATEGGDRKDVFYYQSDDTRYIPRAILIDLEPRVINGIQTGPYKNIYNPENFYVGKNGVGAANNWGDGYQTGESVHEDIMEMIDREADGSDSLEGFMMLHSIAGGTGSGLGSFLLERLNDRFPKKIIQTYSVFPDTQNAGDVVVHPYNSILAMRRLTQNADSVVVLDNGALSHIAADRLHVQEPSFQQTNQLVSTVMSASTTTLRYPGYMHNDLVSILASLIPTPKCHFLMTSYTPFTGDQVEQAKTVRKTTVLDVMRRLLQPKNRMVSTIPGKKSCYISILNVIQGEVDPTDVHKSLLRIRERRLATFIPWGPASIQVALTKRSPYIPMSHRVSGLMLANHTSIATVRNTFVVFLITEFILTKCALNVLQLFKRIVRQYDGMRKRNAFIEGYKKTQPFSENLDEFDEARQVVSDLIAEYEAAEDANYLNPDAGEPGTSAETDRRMG

SEQ ID NO: 462 - DNA, 576 bp, Magnaporthe grisae
atggttcgcccctcatactccaagacggccaaggtgccgcgtcgtcccttcgaggccgctcgattggactctgagctgaagctcgtcggcgagttcggtctcaagaacaagcgtgaggtctggcgtgtccagctcactctgtccaagattcgtcgtgctgcccgtcagcttcttaccctcgacgagaaggaccccaagcgcctgttcgagggtaacgccttgattcgccgtctggtgcgtgtcggtgttcttgacgagtcgcgcatgaagctcgattacgttcttgccctcaaggtcgaggacttcctggagcgccgtctccagacctgcgtctacaagcttggtctcgccaagtccatccaccacgcccgtgtcctcattcgccagcgccacatccgcgtcggcaagcagatcgtcaacgtcccctcgttcgtcgtccgtctcgactcccagaagcacatcgacttcgcccttacctcgccatttggcggtggccgtcccggccgtgtccgcagaaagaaggccaagtccgccgagggtggtgaggacgccggcgatgatgaggacgaggagtaa

SEQ ID NO: 463 - protein, 191 aa, Magnaporthe grisae
MVRPSYSKTAKVPRRPFEAARLDSELKLVGEFGLKNKREVWRVQLTLSKIRRAARQLLTLDEKDPKRLFEGNALIRRLVRVGVLDESRMKLDYVLALKVEDFLERRLQTCVYKLGLAKSIHHARVLIRQRHIRVGKQIVNVPSFVVRLDSQKHIDFALTSPFGGGRPGRVRRKKAKSAEGGEDAGDDEDEE

SEQ ID NO: 464 - DNA, 681 bp, Magnaporthe grisae
atgtcgggcgtatggggatggtttggcggaaacgccgcgcaacggcgaaaggacacgcccaagaatgccatcttggggctgcgatcacaactcgacatgcttcagaagcgtgaaaagcacctgcaaaatcagatttccgaacaggatgcgatcgcgaggaagaacatttcaacaaacaagaatgccgccaaggccgcgttgaagaggaagaagacacatgagcacagtcttgaccaaacgctctcgcagatcggcacccttgagcagcagataaacgctatcgagtctgcaaacatcaacatggaaaccctcgaggccatgaagaaggcaggcaaggccatggaggacatacacggaaagcttacggtagagaaggtcgatgagaccatggacaagttacgggagcagaatgctctcagcgaggagattgtcaacgccatcacaaacaatcagctcggaaacgaggcaatcgacgatgccgacctggaggatgagctggaagcgatggaacaagagcaactggacgagaaaattctcaagacgggcacagggccggtatcggacgcaatccagcgcttaccagcagctgcgaatggagaactcaagggaaaggcaaccaccgtggaagaagacgacgaggaggcagagctcaggaaattgcaggcagagatggccatgtga

SEQ ID NO: 465 - protein, 226 aa, Magnaporthe grisae
MSGVWGWFGGNAAQRRKDTPKNAILGLRSQLDMLQKREKHLQNQISEQDAIARKNISTNKNAAKAALKRKKTHEHSLDQTLSQIGTLEQQINAIESANINMETLEAMKKAGKAMEDIHGKLTVEKVDETMDKLREQNALSEEIVNAITNNQLGNEAIDDADLEDELEAMEQEQLDEKILKTGTGPVSDAIQRLPAAANGELKGKATTVEEDDEEAELRKLQAEMAM

SEQ ID NO: 466 - DNA, 2736 bp, Magnaporthe grisae
atggccaccatcgagccacggctaatgcacttgctgaacgacagtaagagcaatcatgatccaaacgaacttccgcctctacagtcgttcccgatccccaagggctcagctgtgcacgtgtcgctcccctcgctcagcctagaaatcgaacagcgtgatgagcaatttgccgtgaagcttccggccggaccgccactacaccacatacctccgttctcgacgttaaattccctcgacgataatgcttcggcgcaacacatcccgcccctgtctttggttgagtcatctgaggatacgccctcgtcccagcagatcccacctttctcgactttcgaaagtctcgacgatgcgcctcatcgatccggtcctccgaccagactcccaaaccccacctacgtctttgatgggcccgctcgaattccacaaacagccaaccagtcaatacgcgccctcctaggagattccagccctgtagagtcttcatctcactcccttcgcaaaatactcgacgacctgccgcccgagctaggtattcatgacgatgccacaaccaagaagcggcatcgggctttggccggcaaggaggattttgtgcaacttccacagcctctgaagaaacagaagtcggcacagcaggtcatgccacctataatcaatggccttcacgaaccaccacctaacgcggctgtatttcccccgatttcctcggtcgaattcagaaatggcgaccactcgctgagcttgagaccgctcaaagacctgggtcatattccagaggacaggcatgcaccggtcacgccgactgaagacaagacagcacaaccagctgtcaagaccagacgcaggaccaagcccagaaggaagtggacagaggaggagacgaatcatctgctgattggagttagtcggcatggggtcgggaagtggaccagtatattggaggaccctgattttcagttcaacgacaggactgccggtgatctcaaggaccgcttccgcacctgctgccccgatgaattgaggggtcagattaaccccggcgccggtgcaggcaagggaagggcttctcaggcagctaccacttcgcctacttatttaacagatacccaagcgagaaccaagaggactctgatgcttgagaatatcctcattgggaatgattctcagccggaacacgatgccctgaacatgagccctgcaaacgccacggcagccagcacgagcacgtcgcctgtctcttcgtcatcccagccccagccaaaagcatccggagatgcatcccagaaaccccgtaagagtcgagctcaccgaaaaaagcttgaggatcttgctgagcttggaatcagcggcccattcaaaaagtcacaccgacgcgagcgaagacccttcaccgaacaagacgacaaggaaatattggaaggaatccaccgttacgggccagcttggaccaagatacagagggatgaggcctttaatttgtcaagccgtcagccaaccgatctaagggaccgcgtgcgcaacaagtatccagatatctacgccaagatagagaagggagcgtttcagatcatcaaggagccaaacaacagtcatcgtaacaacctcatggagcccacggtgaacactaccattgagaattcgctcacctcggtgaacaaatcaggagggtcatctctagaagctcaactgaaccgtacaggttcaaaggaaaacctcccaaagtggtcgttgcagcactatgcacacgacacgtccgagacgagcacaacgggccaccacgaccaaccaggatcgtcactccctgggaactccggggaaatggacatttcgaggctcaagttgcttttccaagccacagcaaatgcttttcgaagcacggtttctggaatgtttccagtcactcaacatgggtgttaccatcctcagtattgttcttatgacgctgatctacaggcggacagtaagaagcaccagaagcgccttgccgcgccttcgcactggctgttggacaagctcagcggcacctacgcccccaagccctcgcccggtcctcacaagcagcgcgagtgcctgccgctcatcgtcttcatccgcaaccgcctcaagtacgccctcaatggccgcgagaccaaggccatcctgatgcagcgcctggtcaaggttgacggcaaggtccgcaccgactcgacttaccccgccggcttcatggacgttgtttcgatcgagaagactggcgagaacttccgtctcgtctacgacaccaagggacgcttcaccgtccaccgcatccaggccgaggaggccgagtacaagctcggcaaggtcaagcgtgttcagctcggccgcggcgggatcccattcttggttacgcatgatgccagaaccatccgctaccccgaccctctgatcaaggtcaacgacactgtcaagatcaaccttgacactggcaagatcaccgacttcatcaagttcgacactggcgccctcgccatggttaccgctggtaacaacatgggtcgtgttggtgttatcacccaccgtgagcgccacgatggtggcttcaacattgtgcacttgaaggatgccattgacaacactttcaccactcgtgagagcaacgttttcgtcatcggcactgagaagccctggatctccctgcccaagggcaagggtgtcaagctcaccatcgctgaggagcgtgaccgcaggcgtgcccagaccatcgccggccactaa

SEQ ID NO: 467 - protein, 911 aa, Magnaporthe grisae
MATIEPRLMHLLNDSKSNHDPNELPPLQSFPIPKGSAVHVSLPSLSLEIEQRDEQFAVKLPAGPPLHHIPPFSTLNSLDDNASAQHIPPLSLVESSEDTPSSQQIPPFSTFESLDDAPHRSGPPTRLPNPTYVFDGPARIPQTANQSIRALLGDSSPVESSSHSLRKILDDLPPELGIHDDATTKKRHRALAGKEDFVQLPQPLKKQKSAQQVMPPIINGLHEPPPNAAVFPPISSVEFRNGDHSLSLRPLKDLGHIPEDRHAPVTPTEDKTAQPAVKTRRRTKPRRKWTEEETNHLLIGVSRHGVGKWTSILEDPDFQFNDRTAGDLKDRFRTCCPDELRGQINPGAGAGKGRASQAATTSPTYLTDTQARTKRTLMLENILIGNDSQPEHDALNMSPANATAASTSTSPVSSSSQPQPKASGDASQKPRKSRAHRKKLEDLAELGISGPFKKSHRRERRPFTEQDDKEILEGIHRYGPAWTKIQRDEAFNLSSRQPTDLRDRVRNKYPDIYAKIEKGAFQIIKEPNNSHRNNLMEPTVNTTIENSLTSVNKSGGSSLEAQLNRTGSKENLPKWSLQHYAHDTSETSTTGHHDQPGSSLPGNSGEMDISRLKLLFQATANAFRSTVSGMFPVTQHGCYHPQYCSYDADLQADSKKHQKRLAAPSHWLLDKLSGTYAPKPSPGPHKQRECLPLIVFIRNRLKYALNGRETKAILMQRLVKVDGKVRTDSTYPAGFMDVVSIEKTGENFRLVYDTKGRFTVHRIQAEEAEYKLGKVKRVQLGRGGIPFLVTHDARTIRYPDPLIKVNDTVKINLDTGKITDFIKFDTGALAMVTAGNNMGRVGVITHRERHDGGFNIVHLKDAIDNTFTTRESNVFVIGTEKPWISLPKGKGVKLTIAEERDRRRAQTIAGH

SEQ ID NO: 468 - DNA, 4638 bp, Magnaporthe grisae
atggcggaatacggcgagatggacgagtacgccgactacgaggccggcgattacgatgctgagaacgacgacgagatcacggccgaggactgctggaacgtcatctcctcctactttgacgaaaaaggtctcgtttctcagcagatcgactcgtacaatgagttcaccacatcaacaatccagggtatcgttgacgaatactcggttcttacgctggacaacccaaatcctcccgacacttttgaaggaaaacccattcgattgcgccgatatgaaatcatgctcggaaacattctcgtgacccagccgacggttaaggaaacagacggcaaggttagcactttggtgccgtacgagtgccgtgacagaaacttgacgtactcttgcccactctacgtcaagctcaccaagaaggtcaacgtcgcggtcgaagaggatataccgctacatgaactcaacgatgagcagcgcgaggagatgcagaggacgaacgagcaccccactaccattcgttgggagctggacagggacaagtcacacaacccggacgagaagatctcgggcgaaaagatggccgacatgatatacattggcaagattccagtcatggtaaagagtcgaatctgttatctcaggagtcagcccgagtcggaacttttccttctgaacgagtgtccttatgatcagggcggctactttatcatcaacggtagtgaaaaagtcctgatcgcccaggagcgatccgctgcaaacattgttcaggtcttcaagaaggcccaaccaaacaaatacctttaccaggcagaaatccgcagtgccttggagaagggctctcgccttgtctcaaccctgaccatgaagctgacctccaagggtgacagcacgcgtggatcatttggtcagacgatccacctgaacttgccatacaccagtggtgatctcccgatcgccattgtcttccgtgctttgggagtcgtctctgatgaggacatcctgaaccacatagtgttggacaagaacgacacacaaatgctagagatgttgaggcctagtattgaagaggctttctgtattcaagatcgagaagtcgcgctggacttcatcgccaagcgtgtcggcaaggatggtggccactcgaacagcaggcatcttcgtctgaaggtggcacgagacattctgcagaaggacacgctccctcatatctcccaggcagagggttgtgagactcgcaaggcctttttcttgggttacatggtgcacaagatcttgcagtgcgctcttggtcgtcgggatgtcgatgaccgtgatcatttcggcaagaagcgtttggacctggctggtcctctgctagccaaacttttccgtggtatcattcgcaagttgacaaacgacatgatgggtggtctgaggcgatgcatcgacgctggcagagattttgatctcacagcctcgctcaagcccaacactctgacaaatgggttgaaatactcgttggccacgggcaactggggagatcaaaagaaggctgctagctccacggctggtgtctcacaagtgttgaaccgatacacttttgcttcgaccttgtcccatttgcggcgaaccaacactcccattggaagagatggcaagcttgctaagcctcgacagctccacaacactcattggggtctcgtgtgtcctgctgagactcccgagggtcaggcctgtggcctggtgaagaacctgtcgttgatgtgcatggtcagtgtaggtactccggcagagcccatctacgacttcctggtcgcgcgaggaatggacgtactcgaggagtacgagccatcaaactcttcaagtacatcaaagattttcatcaatggcacgtgggtcggtgtagcaaacaagattgaagagttggtagacttggtctacgatcttcgcaggaagagcagagttgaccctgaagtatcacttattcacgacgtccgtgaaggcgagttcaggattttctcagacgccggccgtgtcatgagacctttgtttgttgtcaaccaaaaggatgacccacggacaggtgcccaggcgggcagtctggtgctcaccaaggagcacgttgccaagctgcatgcagacaaggacaacaacctcagccctggagacgagggtcactacggctggcaaggcctgaagagtgatggtgttcttgacttgatggatgctgagcaagaagagacggccatgatctgcatgtcaccaagcgatctagataagttcagagcgctcaagtttggcggtgcaactctggacgagttggaggcctttgacaagaacgatatcaacagaagattgaacaccaagatcaacccgacaactcacatgtacacccactgcgagatccaccccagtatgcttttgggtatttgcgcaagcatcattcctttccctgatcacaaccagtcaccccgtaactgttaccaatctgccatgggtaaacaagccatgggtttcttcctcaccaactacaaccgccgtatggacaccatggccaacattctctattatcctcaaaagcctcttggcacaacccgatccatggagtacctcaagttccgtgagcttcctgccggtcagaatgcaattgtagcaattgcctgctactctggatacaaccaggaagattccgtcattatgaaccaaagcacaatcgatcgcggtctgttccgtagtttgttcttccgttcatacacagactcggagaagcgtgttggtatcaacatggttgagaagttcgaaaagccgttccgtgcggacacgttgaggctcaagcagggcacttacgacaagctcgaagacgacggcatcgttgctcctggtacccgtgtttctggcgaagacatcatcatcggcaagaccgctcctattcccgcggacaaccaggaactcggccagaggactgtgcagcacacgaagcgtgacgcatcgacccctctccgcagtactgaaagcggtatcgtcgaccaggtcatcgttacgaccaaccaagatggtctcaaatacgtcaaggtgcgtgtgcgaaccaccaagatcccgcagatcggtgacaagttcgcatccaggcacggtcaaaagggtacgattggtgtcacatacagacacgaagacatgccattcaccagggagggtattactcctgacattatcatcaacccgcacgccattccatctcgtatgacaattgcccatttgatcgagtgtttgttgtcaaaggtcgcaacgctcaagggtatggagggtgatgccaccccctttacagaggtgacggtggattcggtcagcaacctcttgcgtgagcatggataccaatctcgaggctttgaggttctctatcacggccacactggtcggaagctgagagctcaagtcttctttggaccgacatactaccagcgtctgaggcacatggtggacgataagattcacgcccgagcacgtggtcccgtcaacatcatgacaagacagccagtggagggtcgtgcgcgtgatggtggtctgcgtttcggagaaatggaacgtgattgcatgattgcacacggagcagcctccttcttgaaggagaggttgtttgaggtttcggatgcgttcagggcgcatatctgtggtatttgtgggctgatgacgcccattgccgatctcaccaggaaaacattcgagtgtcggccatgtaggaacaagaccaagatcgcgcaggtgcacataccgtatgcggccaagctgcttttccaggagctggcgtcgatgaacattgccactagaatgtttactgagagggacaagaaagaaacgtacagctttttcggctttttgctgaaagtgcacaaatatcaccgtcgtggcggcaaagagcgaggtgctcagcaggtggcctggctacctgcaccagtgcattcccaaccccgcgacgaaatcgcgtcccgggttaacgcgtctggcaaagaatggaatgatgtaattttctgccgtcccagaccacacgcaacccggccggcgttcctttcatccctgcagcggcgtcggctcgggcttggcgcttgctttggggggcagctccaagaccaaacaacatcaacttgccatcctaatacatccatatctcgccagccgcctactgtaacaacaccggggcaggttaacccgtcaattcgatctctgcagcctgcgacttccttaccgaggccttttgcgacaaacagaattcacaatggttcgtcggatgcaatcgcccaccgcagcgtccacggtagcgaaggagacaccaaagctaaccattcgattcccaacagtctgctcaaagttcagcgggccgagcgtgaggcgtccaagattgtccagaaggtccgcacaaagagagtaaaggaggcccgcgacgaggccaagaaggagatagaagcctacaaggctgagaaggagggcgagtacaaggcatttgagtccaagcacacccaaggcaacaagcaggccgaggaggaggccaacaaggaggccgagaccgagatcaaggagatcaaggaggccggcaagaagcaccaggacaaggtcatcaaggatctgctcaaggccgtctttgagcctcaccctgtgccgccgactgctgcttga

SEQ ID NO: 469 - protein, 1545 aa, Magnaporthe grisae
MAEYGEMDEYADYEAGDYDAENDDEITAEDCWNVISSYFDEKGLVSQQIDSYNEFTTSTIQGIVDEYSVLTLDNPNPPDTFEGKPIRLRRYEIMLGNILVTQPTVKETDGKVSTLVPYECRDRNLTYSCPLYVKLTKKVNVAVEEDIPLHELNDEQREEMQRTNEHPTTIRWELDRDKSHNPDEKISGEKMADMIYIGKIPVMVKSRICYLRSQPESELFLLNECPYDQGGYFIINGSEKVLIAQERSAANIVQVFKKAQPNKYLYQAEIRSALEKGSRLVSTLTMKLTSKGDSTRGSFGQTIHLNLPYTSGDLPIAIVFRALGVVSDEDILNHIVLDKNDTQMLEMLRPSIEEAFCIQDREVALDFIAKRVGKDGGHSNSRHLRLKVARDILQKDTLPHISQAEGCETRKAFFLGYMVHKILQCALGRRDVDDRDHFGKKRLDLAGPLLAKLFRGIIRKLTNDMMGGLRRCIDAGRDFDLTASLKPNTLTNGLKYSLATGNWGDQKKAASSTAGVSQVLNRYTFASTLSHLRRTNTPIGRDGKLAKPRQLHNTHWGLVCPAETPEGQACGLVKNLSLMCMVSVGTPAEPIYDFLVARGMDVLEEYEPSNSSSTSKIFINGTWVGVANKIEELVDLVYDLRRKSRVDPEVSLIHDVREGEFRIFSDAGRVMRPLFVVNQKDDPRTGAQAGSLVLTKEHVAKLHADKDNNLSPGDEGHYGWQGLKSDGVLDLMDAEQEETAMICMSPSDLDKFRALKFGGATLDELEAFDKNDINRRLNTKINPTTHMYTHCEIHPSMLLGICASIIPFPDHNQSPRNCYQSAMGKQAMGFFLTNYNRRMDTMANILYYPQKPLGTTRSMEYLKFRELPAGQNAIVAIACYSGYNQEDSVIMNQSTIDRGLFRSLFFRSYTDSEKRVGINMVEKFEKPFRADTLRLKQGTYDKLEDDGIVAPGTRVSGEDIIIGKTAPIPADNQELGQRTVQHTKRDASTPLRSTESGIVDQVIVTTNQDGLKYVKVRVRTTKIPQIGDKFASRHGQKGTIGVTYRHEDMPFTREGITPDIIINPHAIPSRMTIAHLIECLLSKVATLKGMEGDATPFTEVTVDSVSNLLREHGYQSRGFEVLYHGHTGRKLRAQVFFGPTYYQRLRHMVDDKIHARARGPVNIMTRQPVEGRARDGGLRFGEMERDCMIAHGAASFLKERLFEVSDAFRAHICGICGLMTPIADLTRKTFECRPCRNKTKIAQVHIPYAAKLLFQELASMNIATRMFTERDKKETYSFFGFLLKVHKYHRRGGKERGAQQVAWLPAPVHSQPRDEIASRVNASGKEWNDVIFCRPRPHATRPAFLSSLQRRRLGLGACFGGQLQDQTTSTCHPNTSISRQPPTVTTPGQVNPSIRSLQPATSLPRPFATNRIHNGSSDAIAHRSVHGSEGDTKANHSIPNSLLKVQRAEREASKIVQKVRTKRVKEARDEAKKEIEAYKAEKEGEYKAFESKHTQGNKQAEEEANKEAETEIKEIKEAGKKHQDKVIKDLLKAVFEPHPVPPTAA

SEQ ID NO: 470 - DNA, 2463 bp, Magnaporthe grisae
atgtctgccgacccatcacaggaccctcccaagaagaaggtcaacttggccgatgtatctggcgccgatgtcaaggaggagtcggatgtagcaaccgcaattctgaaaaagaagaagaagccgaatcagttgatggttgccgatgccacaaacgatgacaactccatcatcgcactctccaacagcaccatggaggctttacagctcttccgtggtgacaccgtccttgtgcggggaaagaagcggaaggacacagtcctgatcgtcctagctgatgatgagctggatgacggaagcgcacgactcaaccgtgtggtgcgtcacaacctcagggtcaagcatggagatgtcgtcactatccacccttgccctgacatcaaatatgccaaacgaattgccgttttgccgattgccgacaccgtagaaggcttgacaggctctctgttcgatgtcttccttgcgccctatttccgggaggcctaccgcccagtccgccaaggcgatatttttttggttcgtggtggcatgcgtcaagtcgagttcaaggttgttgaggttgatcctccggagtacggtatcgtagcccaagacacggttatccactgtgagggcgagcccattcagcgtgatgaggaggagaacaacctcaacgaggttggctacgacgacatcggtggctgcaggaagcagatggcacagatccgtgagatggtggagcttcctctgcgccaccctcagctattcaagtcgatcggaatcaagcctccacgcggtgtcctcctctatggacctcctgggaccggaaagacgctcatggcccgtgctgtcgcaaacgagaccggtgctttcttcttccttatcaacggtcccgagatcatgtcaaagatggccggcgagtccgagtcaaacctgcgcaaggcctttgaggaggctgagaagaactcacccgcaatcatcttcattgatgagatcgattccattgcaccaaaacgtgagaagacaaacggcgaggttgagcgccgtgtcgtttcccagctgttgaccctcatggacggcatgaaggcgcgttccaacgttgtggtcatggccgcaacaaacaggcctaactctatcgaccccgccctccgccgttttggacgtttcgatcgtgaggtcgacattggcattcctgacccgaccggtcgtttggagatcctccaaatccacaccaagaacatgaagcttggagatgatgtggacttggagcaaatcgccgctgagacgcacggttacgttggttctgatgttgcggccctttgctcagaggcagccatgcaacagattcgggagaagatggatctcatcgacctcgatgaggacaccattgatgctgaggttcttgactctctaggtgtcaccatggagaacttccgctttgcccttggcgtctccaacccttcggctctgcgtgaggttgcagttgtcgaggtgcccaacgttcgctgggaggatatcggtggtctggacgaggtcaagcaggacctcagggagcaggtccagtacccagtcgaccaccccgagaagttcctcaagttcggtctctcaccatcgcgtggcgtgcttttctacggtcccccgggtaccggaaagaccatgttggccaaggccgttgccaacgagtgtgcagcaaactttatctccgtcaagggtccagagctgctcagcatgtggtttggagagtcggaaagcaacattcgtgatatcttcgacaaagcgcgcgctgcggcaccttgcattgttttccttgacgagcttgactcaatcgccaaggctcgtggaggctcggtgggtgacgccggcggtgcatcggaccgtgttgtaaaccagctgctgacggagatggacggtatgacttccaagaagaacgtgttcgttattggagcgaccaaccgtccggagcaattggatcccgccctttgccgtcctggacgtcttgactcgctcatctatgtgccgcttcctgatgagctgggccgcctcagcattctcaaggctcagctgcgcaagacgcccgtctcagatgatgtcgaccttcagtacatcgccaacaagacgcacggcttttctggtgccgatcttgggtttatcactcagcgtgctgtcaagatcgccatcaaggagtccatcacggccgacatcaaccgcactaaggctcttgaggctgcaggcgaggatgtccccatggacgaggatgccgaggaccctgtccccgagttgacgaagcgtcactttgaggaggccatgcaacaggctcgcaagtcggttagcgatgtcgagatccgtcgctacgaggctttcgcccagcagatgaagaatgctggcccgggcgccttcttcaagttccctgaaggcgagggtgcaccggcagccagcggcggcgagacattcaacgacggtggtaacgacgatggtctgtacgactaa

SEQ ID NO: 471 - protein, 820 aa, Magnaporthe grisae
MSADPSQDPPKKKVNLADVSGADVKEESDVATAILKKKKKPNQLMVADATNDDNSIIALSNSTMEALQLFRGDTVLVRGKKRKDTVLIVLADDELDDGSARLNRVVRHNLRVKHGDVVTIHPCPDIKYAKRIAVLPIADTVEGLTGSLFDVFLAPYFREAYRPVRQGDIFLVRGGMRQVEFKVVEVDPPEYGIVAQDTVIHCEGEPIQRDEEENNLNEVGYDDIGGCRKQMAQIREMVELPLRHPQLFKSIGIKPPRGVLLYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILQIHTKNMKLGDDVDLEQIAAETHGYVGSDVAALCSEAAMQQIREKMDLIDLDEDTIDAEVLDSLGVTMENFRFALGVSNPSALREVAVVEVPNVRWEDIGGLDEVKQDLREQVQYPVDHPEKFLKFGLSPSRGVLFYGPPGTGKTMLAKAVANECAANFISVKGPELLSMWFGESESNIRDIFDKARAAAPCIVFLDELDSIAKARGGSVGDAGGASDRVVNQLLTEMDGMTSKKNVFVIGATNRPEQLDPALCRPGRLDSLIYVPLPDELGRLSILKAQLRKTPVSDDVDLQYIANKTHGFSGADLGFITQRAVKIAIKESITADINRTKALEAAGEDVPMDEDAEDPVPELTKRHFEEAMQQARKSVSDVEIRRYEAFAQQMKNAGPGAFFKFPEGEGAPAASGGETFNDGGNDDGLYD

SEQ ID NO: 472 - DNA, 651 bp, Magnaporthe grisae
atggccgaggctcagcaagtccccaccttcaagctggtgcttgtcggtgacggtggtaccggaaagaccaccttcgtcaaacgccacttgactggtgagttcgagaagaagtacatggccacccttggtgtggaggttcacccgctaggcttcgagacgaactttggcaagattcaattcgatgtgtgggacaccgcaggccaggagaagttcggtggtctgcgtgacggttactacatcaacggccagtgcggtatcatcatgtttgacgtcacatcccgcatcacctacaagaacgtccccaactggcaccgtgacttggttcgtgtgtgcgagaacatccctattgttctctgcggtaacaaggtcgacgtcaaggagcgcaaggtgaaggccaagaccatcaccttccacaggaagaagaacctgcagtattacgacatctcggccaagtcgaactacaacttcgagaagcctttcctgtggctcggccgcaagcttgttggcaaccccggtctggaattcgttgccgcccccgcccttgctccccccaccgccgaggtgaccgcagagcaggcggccgcgtacgagaaagaccttgcagatgctacgcgtgcgcccctgcccgatgatgatgatgaagacttctga

SEQ ID NO: 473 - protein, 216 aa, Magnaporthe grisae
MAEAQQVPTFKLVLVGDGGTGKTTFVKRHLTGEFEKKYMATLGVEVHPLGFETNFGKIQFDVWDTAGQEKFGGLRDGYYINGQCGIIMFDVTSRITYKNVPNWHRDLVRVCENIPIVLCGNKVDVKERKVKAKTITFHRKKNLQYYDISAKSNYNFEKPFLWLGRKLVGNPGLEFVAAPALAPPTAEVTAEQAAAYEKDLADATRAPLPDDDDEDF

SEQ ID NO: 474 - DNA, 2313 bp, Magnaporthe grisae
atggattatgaaaacctgaaggaacagtggagcgaggttgaggatcgcgatggcgtccgcctcagctggaacgtctttccgagcacgcgcatggaagcgtctcgcctcgtcgtcccgatcggtgccctctacacccctttgaaggagaagccagacactcccctgctgcagttcgagcccgtcacctgcaagcagccatgccgttccgtcctgaacccattctgccaggttgatgttcgtgctcgcctctggatctgcccgttttgtctctctcgaaaccctctgccgcctcactacaaggacatcacggccaacgccatccctccagagctgcacccatccaataccacaatcgagtaccgcctgtcccgcccggccccgagtccgcctatctttctctacgtggttgatacctgccaggaggatgacagcctcaacgctctcaaggagtctctcgtcatgagcctaagcctccttcctgagaacgccctcgtcggcctcatcacctacggcacaatgactcaagtccacgagattggctacaccgagtgcgccaagtcgtatgtcttccgtggtagcaaggactatgcgccgaagcaggttcaggagatgcttggcctcggccagatgcccgtccgcccgggcatgcagccccagccgggacgcccgatgcctatgggacccgcctctaggttcttgatgccggtttcccagtgcgagttccaacttaccaaggccttggagcagctccagaaggacccatggccagttgccaacgataggcgaccgctgcgttgcactggcgtagccttgagcgtcgctgttggtcttcttgagtcttccttccagaactctggtggccgcatcatgctttttgctgccggtcctgccactgagggccccggtatggttgtcagctccgagctcagggaacccatgcggtcgcatcacgacattgaccgtgacaacatcaagtactacaagaaggctctcaagttctacgacactctggccaagcggaccgcccataacgggcacataatagatatctttgctggttgccttgaccaggtcggtcttctggagatgaaaggtctcagcaactccacaggtggtcatatgattttggtcgatagctttacgtcgtccatgttcaagcagtcgttcgtgagggtattcgaaaaggatggagacgacaacctgctcatgggtttcaacggtatcttggaggtcctgaccaccaaggagctcaaggttacaggtctgattggtcacgccgtctcgatgaacaagaagtcgacctctgtcggtgagaccgagtgcggtattggcaacacgtgctcgtggaagatgtgcggtattgacccaacatcaagctacggcatctacttcgaggttgcacaaggtggcccgtcacacgcccaaccagctcagaaagggatgatgcaatttctcacatattaccagcactcatctggacagttccacctgagggtcacaaccattgcccggaacataggcggtcccgccggagatccggcgattgcacagtcttttgaccaggaggctgccgcagtgctcatgtcgaggatcgcagttttcaaggcggaagtagacgacggaccagatgttctgcgctgggtcgacaggatgcttatcagtctctgctcaaggtttgccgactacaggaaagacgacccgtcatctttcaggctcgagaagaactttactctttacccgcagttcatgttccacctgaggaggagtcagttcttgcaggtcttcaacaactcgcccgacgaaactgccttctaccgacatgtcctcaaccacgaggacgtgagcaattccctcatcatgatccagcccacgctggatacatacacgtttgaccaggaaggtggacagcctgtgctgctcgactcagcctcgatccagcccacgcacattctgctgcttgacaccttcttccacattctcattttccacggcgagaccatcgcacagtggaagaaggccggataccaggaccaggagggatacgagaactttgcccagctgctgcaacagccaaaggaggatgccatggagctcattacggaccgattccccttgcctcgtttcatcgtgtgtgacgcaggtggatcgcaggcacgtttcctgctctcaaagctgaatccctcgacaacgcacaccaccggcgcatacggtggcgtgggtgcacaaacggcacagaccatctttacagatgacgtttcgctgcagacttttatggaccacctcatgaagttggctgttagtggcaccaactag

SEQ ID NO: 475 - protein, 770 aa, Magnaporthe grisae
MDYENLKEQWSEVEDRDGVRLSWNVFPSTRMEASRLVVPIGALYTPLKEKPDTPLLQFEPVTCKQPCRSVLNPFCQVDVRARLWICPFCLSRNPLPPHYKDITANAIPPELHPSNTTIEYRLSRPAPSPPIFLYVVDTCQEDDSLNALKESLVMSLSLLPENALVGLITYGTMTQVHEIGYTECAKSYVFRGSKDYAPKQVQEMLGLGQMPVRPGMQPQPGRPMPMGPASRFLMPVSQCEFQLTKALEQLQKDPWPVANDRRPLRCTGVALSVAVGLLESSFQNSGGRIMLFAAGPATEGPGMVVSSELREPMRSHHDIDRDNIKYYKKALKFYDTLAKRTAHNGHIIDIFAGCLDQVGLLEMKGLSNSTGGHMILVDSFTSSMFKQSFVRVFEKDGDDNLLMGFNGILEVLTTKELKVTGLIGHAVSMNKKSTSVGETECGIGNTCSWKMCGIDPTSSYGIYFEVAQGGPSHAQPAQKGMMQFLTYYQHSSGQFHLRVTTIARNIGGPAGDPAIAQSFDQEAAAVLMSRIAVFKAEVDDGPDVLRWVDRMLISLCSRFADYRKDDPSSFRLEKNFTLYPQFMFHLRRSQFLQVFNNSPDETAFYRHVLNHEDVSNSLIMIQPTLDTYTFDQEGGQPVLLDSASIQPTHILLLDTFFHILIFHGETIAQWKKAGYQDQEGYENFAQLLQQPKEDAMELITDRFPLPRFIVCDAGGSQARFLLSKLNPSTTHTTGAYGGVGAQTAQTIFTDDVSLQTFMDHLMKLAVSGTN

SEQ ID NO: 476 - DNA, 1011 bp, Magnaporthe grisae
atggcaggcgagcgaggcaatgagatggctgaagttttgaaggatttccccgagcttgagattgaggtcgagggccgcaaagagccgatcatgaagcgtaccacccttatcgccaacacatcgaacatgcccgtggccgcgcgtgaggcctcaatttacacgggaattacagtagccgagtacttccgtgaccagggcatgaacgttgccatgatggcggactcttcatcccgttgggctgaggctctccgtgagatctcgggtcgtcttggtgagatgcctgctgatcagggtttccctgcttacctgtctgccaagcttgcttccttctacgagcgtgctggaaaggtcaacgccttgggctcacctgagcgcggtggaagtgtcagcattgtcggtgccgtcagcccgcccggtggtgatttctcggatcctgtgactacatcgaccctgtccattgtccaggtcttctggggtctcgacaagaaactggcacagcgcaagcacttcccgtccatcaacacttccctttcgtacagcaagtacacgatgatattggagaagtggtacgagaaggagcaccccgacttcccacgtctgcgtgaccaggtcaggcagctgctgtcagactcggaggagctggaccaggtcgtgcagcttgtcggcaagtcggcgctttcggaccccgacaagatcacacttgacatggccacgctgctcaaggaggactttttgcagcagaacggctacagtgactacgaccagttctgtcccatctggaagacagagtggatgatgcgcctgatgatgggtttccacgacgaggcgcagaaggcgattgcacaaggccaaagctggagcaaggtgcgcgaggctacccaggacctgcaggccaagctcaagagcctcaagttcgaggtaccgaccgacggcgaagaggttatttgcaagaagtatgaggccatccgcaacgaaatgctggaaaagtttgcatctgtcatggacgagtaa

SEQ ID NO: 477 - protein, 336 aa, Magnaporthe grisae
MAGERGNEMAEVLKDFPELEIEVEGRKEPIMKRTTLIANTSNMPVAAREASIYTGITVAEYFRDQGMNVAMMADSSSRWAEALREISGRLGEMPADQGFPAYLSAKLASFYERAGKVNALGSPERGGSVSIVGAVSPPGGDFSDPVTTSTLSIVQVFWGLDKKLAQRKHFPSINTSLSYSKYTMILEKWYEKEHPDFPRLRDQVRQLLSDSEELDQVVQLVGKSALSDPDKITLDMATLLKEDFLQQNGYSDYDQFCPIWKTEWMMRLMMGFHDEAQKAIAQGQSWSKVREATQDLQAKLKSLKFEVPTDGEEVICKKYEAIRNEMLEKFASVMDE

SEQ ID NO: 478 - DNA, 585 bp, Magnaporthe grisae
atgaagtacatccactcagaggagctcctggaggtgccggagggagtcaagatcagcatcaagtccaggctgattactgttgagggcccccgaggaaagctcactaagagccttaaccacatcgccgtcaccttctcgcaacccagcaagaacgttatcggcatcgagattcaccacggcaagcgcaaggatgtcgccaccctccgtaccgtccgcaccctgatcaacaacttgatcattggtgtcaccaagggctacaagtacaagatgcgttacgtctacgcccatttccccatcaacgtcaacgttgagaagaacaacgagactggcaacgccgaggtcgagatccgaaacttcatcggcgagaagctcgtccgcagggtcgccatgcagcctggtgttgaggttgagatctcaaaggcccagaaggatgagctcatcctgtccggtaactctgtcgaggctgtctcgcaaagcgccgccgatatccagcagatctgcaaagtacggaacaaggatatccgtaagttcttggatggtatgtacgtctcggagaagggcaacatcgaggagattgctgcataa

SEQ ID NO: 479 - protein, 194 aa, Magnaporthe grisae
MKYIHSEELLEVPEGVKISIKSRLITVEGPRGKLTKSLNHIAVTFSQPSKNVIGIEIHHGKRKDVATLRTVRTLINNLIIGVTKGYKYKMRYVYAHFPINVNVEKNNETGNAEVEIRNFIGEKLVRRVAMQPGVEVEISKAQKDELILSGNSVEAVSQSAADIQQICKVRNKDIRKFLDGMYVSEKGNIEEIAA

SEQ ID NO: 480 - DNA, 1008 bp, Magnaporthe grisae
atggaacgcttccgaagtatgatgaacggtatgggcggccagcttggcgctgcccccggaacgttgatcgacaacgccgagaccgtctatatttcttcccttgccctcctaaagatgctgcggcacggccgcgccggtgtgcccatggaagtcatgggacttatgctgggcgagtttgtcgatgacttcacagtacgcgtcgttgatgtttttgccatgccacaaagcggtactggagtcagtgtcgaggcagtcgacccggtgttccagatgaagatgatggatatgttgcggcaaacaggaaggcccgagtccgtcgtgggctggtaccactcacatcccggtttcggctgctggttgtcgtcggtggatatcaacactcagcagagtttcgagcagctcacaccacgtgccgtcgctgtggtcgttgacccgattcagtccgtcaaaggaaaggttgtcatagacgctttccgtctcatcaacccgcaatctctcatgctcggacaggagccccgccaaagcacatccaaccttggccacctcaacaaaccctcgattcaagcattgatccacggtctgaaccgccactactactcgataaacatcaactaccgcaagacagcgctcgaggagaacatgttgatgaaccttcacaagcaagtatggaccgagtccctgcagatggatgatttccgtacccaaggacagaacaacaaggagcgcttggaccggctggtcagcttgtcagaaggttacgagaagcgcgtgaaggaggagacggagcttaccaaggaccagctgaagacgcgctacgtcggaaagctagacccgaagaagcatttggaggatgttggtcagcagctcatcgaggacaacattgtcgccgtatcaaggcagatgattgacaaggaggctgcggtgctggagaagaaggcgtctgctgttggagcaagcggcaaggggcgttcagaggacgatcaaatggatgtcgaggaagacctatga

SEQ ID NO: 481 - protein, 335 aa, Magnaporthe grisae
MERFRSMMNGMGGQLGAAPGTLIDNAETVYISSLALLKMLRHGRAGVPMEVMGLMLGEFVDDFTVRVVDVFAMPQSGTGVSVEAVDPVFQMKMMDMLRQTGRPESVVGWYHSHPGFGCWLSSVDINTQQSFEQLTPRAVAVVVDPIQSVKGKVVIDAFRLINPQSLMLGQEPRQSTSNLGHLNKPSIQALIHGLNRHYYSININYRKTALEENMLMNLHKQVWTESLQMDDFRTQGQNNKERLDRLVSLSEGYEKRVKEETELTKDQLKTRYVGKLDPKKHLEDVGQQLIEDNIVAVSRQMIDKEAAVLEKKASAVGASGKGRSEDDQMDVEEDL

SEQ ID NO: 482 - DNA, 1827 bp, Magnaporthe grisae
atgggtatcgttgggctcgttactgccgacagaggccagatgggtgcaaacaagtcggctcagttgaatacagttcaggaactgtgcagactcggacgtggtctggcctttattggcagatggctggtaggggagttgctccgcggtgatagaactgcccccctttggtatgcaagccgcatattgaattcgcggcctctcgttcgcgatagtctgtccatttcatattcccgagcaccaatcagcaagacatatacagacaaccccaagacaactgcgaaaatggtggtcctcgcagcttcaatctgcactcgcggcggcaaggctgtcctgtcgaggcagttccgcgagatgccccggtcgaggatagaagctttgctcgcctcgttcccaaagcttgccgacagtggtacccagcacacgaccgttgagcaggacaatgttcgattcgtctaccagcccctcgacgagctctacatggttctcatcacgaaccgtcagtccaacatccttcaggatatcgactccctgcaccttttcgcacaggttgtgaccagcacttgcaagagcttggacgagcgggagattctcaagaatgcctacgaactccttagcgcctttgacgagctggttactctgggctacagggagaacttgaccattagccagatcaagaccttcctcgagatggagagtcacgaggagcgcatccaggagattattgcgaggaacaaggaactcgaggccacggaggagcgcaagaggaaggccaagcagctggagatgcagcgtaaagagtctgctcgcagtggtaggcccggcggcgcacagagagcaccagtctacccgacatatacacctccgtctcgccctgcagtcacagacacctatgacacgtacgaggctgagaagaacaagtcaaaattcactgcaccaaagggcaagggcatgcagcttggcaagaaatccaagacgacggatatgttcgagcgggtgcgcggagatatgggcaacgagatcgacgatacgccgcttgttgctcccacagcttccgccgcacccctcgcttcggagccgccgcgccggcaatctgttggcacggaccgcgattctatccatatcaccgtatcagagaatattactgccaagatctcaagggaaggcacactaaattcgctgggtgtcaagggtgacttgaacctgcgggtatcggacccgacgatgaccaagatcaaactgcagcttgtggccaacccgacgcacggtgcccaattccggacacatcctaacgtagaccgcaaccttttcaacagctctaaggtcatccaaatgagcaaggctgataggggcttccccgtcaacaactcagtcggtgtgctgaggtggatggcgacgccgaaggcagacgacactagtgcgcttccgatcagcttcaccgtctgggtcaacaagggctctgatggaaactgcacattaacggtcgagtacgaactcactggaggagacgagctcagggacgtcagcgtctccatcccatactcgagcacagagccgacggtgtcgagctttgatgccacgtatgaggtgtccggagacaaccttgagtgggcgattggcacggtcaatgaggagaatgccaatggctcatttgagtttgaggcaatggccgacgatgaaaacgagtttttcccgatgcaggtccggttctccaagacgaccccatttgttgacgtggatatttcgtcggtgacgctccttgaaatgaacgaggaagtcactttctcaaaagacgtgaggtgtactgccgacacttacttgatcgaatag

SEQ ID NO: 483 - protein, 608 aa, Magnaporthe grisae
MGIVGLVTADRGQMGANKSAQLNTVQELCRLGRGLAFIGRWLVGELLRGDRTAPLWYASRILNSRPLVRDSLSISYSRAPISKTYTDNPKTTAKMVVLAASICTRGGKAVLSRQFREMPRSRIEALLASFPKLADSGTQHTTVEQDNVRFVYQPLDELYMVLITNRQSNILQDIDSLHLFAQVVTSTCKSLDEREILKNAYELLSAFDELVTLGYRENLTISQIKTFLEMESHEERIQEIIARNKELEATEERKRKAKQLEMQRKESARSGRPGGAQRAPVYPTYTPPSRPAVTDTYDTYEAEKNKSKFTAPKGKGMQLGKKSKTTDMFERVRGDMGNEIDDTPLVAPTASAAPLASEPPRRQSVGTDRDSIHITVSENITAKISREGTLNSLGVKGDLNLRVSDPTMTKIKLQLVANPTHGAQFRTHPNVDRNLFNSSKVIQMSKADRGFPVNNSVGVLRWMATPKADDTSALPISFTVWVNKGSDGNCTLTVEYELTGGDELRDVSVSIPYSSTEPTVSSFDATYEVSGDNLEWAIGTVNEENANGSFEFEAMADDENEFFPMQVRFSKTTPFVDVDISSVTLLEMNEEVTFSKDVRCTADTYLIE

SEQ ID NO: 484 - DNA, 1342 bp, Magnaporthe grisaee
atgccagggtacgactctcgttgtctccacgtagatatgagaattcaagagttccccgagatcggccattcatctcttaaacgatctccagcagggacatgtcgtcaagctcccagtgcatttctgcagggtggaagagctgttgcgaagacgactggatcagaaggacaatttacagagattgctagagtggtgattgcaatcatgtcattaccggcaatgaggcaggcggcttcgagggcgctgaggatgcgtgggcccgtgggccggcacgtcaggatggtgtcgacggcttcgcatgagagccagcagaggctgctctcctcgcacctgcaaaccgcagacccggccatgtacgatattgtcgagaaggagaagcagaggcagaagcactacatcaacctcattccgtcggaaaacttcacatcccaggccgtgctggatgctttaggaagcccgatgcagaacaagtattccgagggttaccccggggcgaggtattacggcggtaacgagttcatcgatcaatccgagaggctatgccagcaaagagcattggagacttttggtttggatgacaagcagtggggagtgaacgtgcaagctctctctggcgcccccgccaacttgtacgtatactcggccctcatgggcgtccacgaccgcatgatgggtctagacctgcctcacggcggccatctttcccacggataccagacgccgaccaagaagatctcgttcatctcaaagtactttgagacggtcccctaccggctggacgagtcgaccggctacatagactacgacaagctggaggagctggcacacatctaccgtcccaagatcatcgttgcgggcacctcggcctacagtcggtttatcgactacaagcgcatgcgtgagatctgcgacaaggtcaacgcatacatgctggccgacatggcacacatctcgggtatggtcgcggccaaggtcatcccgggaccttttggctacgccgacattgtgaccacgaccacccacaagtctctgaggggccctcgcggtgccatgatcttcttcaggaagggcgtgcgttcgacgaaccccaagaccaaggctgaggtcatgtacgaccttgagaaccccatcaaccagtccgtcttccccggtcaccagggcggacctcacaaccacaccattgcggccctggccgtggcgctcaagcaggcgcagatgcccgagttccgcgcgtaccaggagcaggtcctcgtcaacgccaaggcttttgcccgccgtctgggtgaggccaagggcaacggcggcggtctgggatacaagatcgtctcgggcggcacggagt

SEQ ID NO: 485 - protein, 447 aa, Magnaporthe grisae
MPGYDSRCLHVDMRIQEFPEIGHSSLKRSPAGTCRQAPSAFLQGGRAVAKTTGSEGQFTEIARVVIAIMSLPAMRQAASRALRMRGPVGRHVRMVSTASHESQQRLLSSHLQTADPAMYDIVEKEKQRQKHYINLIPSENFTSQAVLDALGSPMQNKYSEGYPGARYYGGNEFIDQSERLCQQRALETFGLDDKQWGVNVQALSGAPANLYVYSALMGVHDRMMGLDLPHGGHLSHGYQTPTKKISFISKYFETVPYRLDESTGYIDYDKLEELAHIYRPKIIVAGTSAYSRFIDYKRMREICDKVNAYMLADMAHISGMVAAKVIPGPFGYADIVTTTTHKSLRGPRGAMIFFRKGVRSTNPKTKAEVMYDLENPINQSVFPGHQGGPHNHTIAALAVALKQAQMPEFRAYQEQVLVNAKAFARRLGEAKGNGGGLGYKIVSGGTE

SEQ ID NO: 486 - DNA, 1798 bp, Magnaporthe grisae
cattagggtcattgagttttgactcaggtcctactagataccttacctagtacctcagcttggttggtagatttaccttggttccttactcgtcagagattgaccttggagatgaattaccttaggcgttcggacgtcaattcagttctccactcctttcaacggagcctgtgtccgaaatatcacgtgaatcaacggccaagcggagtggaccgttggtggaaatgcttctatttgcctgacaatcaaggcataaaatagctttagggttcgaaaatgtgagcggggcctagcccacaaggaaaagtgaccggggcaaattcgctgcgcaccccacccaaaagtgcagtagaggaaaatatacgtgcctgcccgatttcgacctctgccacttgaaatcgcccattcgacgccgacccgagtagacgaccgaccagcaaacctccaaaacaccaaaggcaccgggcccccgaaggagaataaacaacacatcagacacaatggccgacgcagcaccccgtggcggcggtttcgcatcgcgtggaggagaccgtggcggcgaccgcggccgtggtgaccgtggccgtggacgtggacgtggccgtggccgtcgtggcggcaagtccgacgagaaggagtggcagcccgttaccaagctcggccgtctcgtgaaggccggcaagatcaagagcatggaggagatctacttgcactcgctccccatcaaggagtaccagatcgtcgactttttcctgcccaagctcaaggacgaggtcatgaagatcaagcccgtccagaagcagacccgtgccggtcagcgtacccgtttcaaggccatcgtcatcattggtgactccgagggccacgttggtctgggtatcaagacctccaaggaggttgccactgctatccgcgccgccatcattattgccaagcttagcgtcatccccgtccgtcgtggttactggggtaccaaccttggtactcctcactcgctccccgtcaaggagagcggcaagtgcggttccgtcactgtccgccttatccctgctccccgtggtaccgccctggttgcctcgcccgctgtcaagcgtctcctccagcttgctggtatcgaggatgcctacacatcgtcgtcaggctcaaccaagaccctcgagaacaccctgaaggccactttctcggccgtttccaacacatacggtttccttacccccaacctgtggaaggagaccaagctcatcaggagcccgctggaggagtttgccgacaccctcagggacggcaagcgttactagatgtttgggacgatggtttaaattttctgacggtcgtcggggcgtctttgatctggctttcttcatttgcatgggtttacggacggggcatcaactttcggggtcattcaaaaagcaatttgttatgacctgatttgaacgaaatgagacttcaaccaacgatggattaccatgcggctcgccagtgaaaactaacttagtgtcgaagtgattatgcaaaaaggggttgttatcccaggcactgtgctggcaagtgccatggcgtgcgaacagaacaagacttggcgtcattttgaggcatctaccgaccagtcttatactgttaaggggttagacaaagatcaacacgtcgttatgcgtggaatcggttaaggaaaacatctcgcctggtagtaatcaggtgctcatgttcaaaggtcattgtgtatcgggcgcggcatacgaagtgctcgccccgttatcaactacctaggcaggtaggtaggtacccacctaccttt

SEQ ID NO: 487 - DNA, 2461 bp, Magnaporthe grisae
gcctcgaggttgccaaaagcgggaccacatgatgtcagcagcccagtatacgctatggtacaagttgtacaacggctaggtacaaattggggtagcggggaaagccactaactacatcacaaaatggttcctcttcgattttcaggagtccttttcgctgtaaatatcaaataaaggttaaatctaagtgtgcatgcatatgtcgtatgacaaggaagtccttggacaaatgtacctatcggattggggaggctttcactgtggactgggggtggaaatgtaggggaccttccgtaggtaggtagtagaaagctcccacgtaaagagtggagagtagcaatggtccgacccagtcccacccaccctcaacagcgacaccgcaaaatcgcgttgcagacgcgttcgagctggagggcagctctcgaaaccaaggatcacaacgtctgatcattattctacagagtaaacttgctgtaatcagcgcttaaacaaaccacaagatgccgagagaaatcattacgatccaggctggccaatgtggcaacagcattgggagtcagttctggcagcagctttgtcaagagcacggaatcaatcaagatggtaacctggaagactttgcgaccgagggcggcgatcggaaggacgtcttctactaccaaagcgacgacaccaggtatattcccagggcaatattgattgatctggaaccccgggttatcaacggcatacaaacgggtccctataaaaacatatacaacccagagaacttctatgtcggcaaaaatggtgtaggcgcggccaacaactggggtgatggctatcagactggcgagtcggttcacgaagacattatggagatgattgatagggaagcagatggaagcgactcactcgagggctttatgatgctgcattcgattgctggtggcacaggctcaggtctgggctcattcctcttggaaaggctaaatgaccgatttcccaagaagatcatacaaacgtattcggtatttccggatacccagaatgccggagacgtcgtcgtccatccctacaacagcatcctagccatgaggagattgacacagaatgccgactcggtggtggtgctggataacggcgctctctcacatattgcagccgatagactccacgtgcaagagccgtcttttcagcagacaaatcaactggtctctactgttatgtctgccagcacaacgacactgcgatacccaggctacatgcacaatgacctcgtcagcatattggcgtccttgatccctacgcccaaatgccacttcttgatgacatcatatactccttttacgggagatcaagtcgagcaggcaaagacggtgcgcaagacgacagttttggatgtcatgcgcaggttactgcagcccaagaaccgcatggtttcaacgatacccgggaagaagagttgttacatttcaattctcaatgtgattcaaggcgaagttgatccaaccgatgttcacaagtctttgctgcgcattcgtgaaaggaggttggcaacttttattccttggggaccggcgagtatccaggttgctttgaccaaaaggagcccatacataccaatgagccaccgtgtcagcggtctcatgttagccaaccacaccagcattgctacagtaaggaacacttttgttgtatttttgatcacagaattcatactgaccaagtgcgcccttaatgttctgcagcttttcaaaaggatcgtaaggcaatacgacgggatgcgcaagcgcaacgcattcatagaaggctacaagaagacacagccattctcggaaaaccttgatgagtttgacgaagcgcggcaagtggtcagcgaccttatcgcagagtacgaagctgccgaagatgccaactatttaaacccggatgccggtgagcctggcacctcggccgagacggatcggagaatggggtgaatacgtcttctagctgcgcgtctcgttcacttgttgcaatttcaataccctgtcggcgttctggatgttgtcgttctatgggatacatggtttgcgaaggaaaattggtggttatcaagtcaatcttagaggccaacacattcgactctagacaattatgactgaaaatgaatgataatttcctcttgttcatctcaaaccccgggcgatatttccagcgcttttgaaaccattcgagattcattgcaggggcgggcaaaaagctgtaagtcataatcacatggttttcattgccttgcgaggtcttgttctcgagcttcaggtgatgcaagtcattggctgtgattgcgactgattatattgtacaaattcgaaccccatacatccaacatcctatttcgacgcatccttgggcgtctccgacagcccttccttcccttgccttccaataccgctcatgtcaacgcccgcgccgacggtggcgggttcacgcagccccg

SEQ ID NO: 488 - DNA, 1576 bp, Magnaporthe grisae
gagaatgcatagcgcgtgcccgcccctgtgagagagagatatcgcggtcagcaatagagatccattgtggtggtttttgttggtttgaaagtgagataaagggaaggggcacagactcaagcccgccgggtgtcccatattgacgtcttagtgtgttgatttaagggagatgagttgtaaaggtccgcagcgtgtctcgagactgtggccgacgtttggtgatgtgaggctgttgatgtgcgacttttgttaaggtggactagattctgcgacagtgagtgcgcagtagtggggcgacattacataagcggcagcaaatttcacctcgaagaggaattaggaaaccctaaggtggggcgcacctgctcttttcgtccctccgctgctctagaatatcaccagttctgtatttgctcctcgtacaattctcctccttggactgctctctcttttgtgcctcactaccagcctctcgccgacacaaacacaagtcaacagccatggttcgcccctcatactccaagacggccaaggtgccgcgtcgtcccttcgaggccgctcgattggactctgagctgaagctcgtcggcgagttcggtctcaagaacaagcgtgaggtctggcgtgtccagctcactctgtccaagattcgtcgtgctgcccgtcagcttcttaccctcgacgagaaggaccccaagcgcctgttcgagggtaacgccttgattcgccgtctggtgcgtgtcggtgttcttgacgagtcgcgcatgaagctcgattacgttcttgccctcaaggtcgaggacttcctggagcgccgtctccagacctgcgtctacaagcttggtctcgccaagtccatccaccacgcccgtgtcctcattcgccagcgccacatccgcgtcggcaagcagatcgtcaacgtcccctcgttcgtcgtccgtctcgactcccagaagcacatcgacttcgcccttacctcgccatttggcggtggccgtcccggccgtgtccgcagaaagaaggccaagtccgccgagggtggtgaggacgccggcgatgatgaggacgaggagtaaatttctcgttctgtttctcgtcattatgcactggctgggttatgaagggtttcatcaaaaaatgtcttttttcggcggtcatgggaaaaatcggagtctaaagtcactgattcacggcgttttgggccacggcatgtggtatgaattcacgtaacggagccttttgatgctcccaaatacaaagaaatccttgacctcgtctgttaatgtccccgtgatgtcttgaagcgaaagtggacctcgacttcgtgtgctggtcagactttctcggagcgcacacggccaattttattataaacgtctataggggtagggttactcggtaagcggcggccgacacaatgagttgctggcattattatggggccaattgtcacttcgctctatgttgaaatgttctacatacaagtgtcacgcgactcgcgagggtaagagacaagttgaaattgagctctcggtagcaatcagaacatctcagcttttgccacaagccacctccc

SEQ ID NO: 489 - DNA, 1681 bp, Magnaporthe grisae
gatgactaagctcggaagatgtccggcagaacattgctgtggctcatctctggaatctacttgcatcatacccccgtcccgtgcccaggcagctggcgtcggacctaccagatgacatcgccgtcattcccacccaactatcacctcaatctttggcgacgaaacattcccgagcaccgcgttgcggctcgcacttattacaataccactcgaagttatcgttggctctatcccttgacgaccttttaattgacgactacgtaacgagagtcctgcgtcgactcataccccgccaacaacccggcttatcaagttccgcgcggggcgagataggacagccgtgacgcaagcctacggccgcgttcaggtccgaaacgaaccagacgatagacgactttgacctacggaacggggctcatacaccacgtacaccaggcgggcggccgagttggactctatacaaccacgttggcctttacttacacaacaagcaattaatcatgtcgggcgtatggggatggtttggcggaaacgccgcgcaacggcgaaaggacacgcccaagaatgccatcttggggctgcgatcacaactcgacatgcttcagaagcgtgaaaagcacctgcaaaatcagatttccgaacaggatgcgatcgcgaggaagaacatttcaacaaacaagaatgccgccaaggccgcgttgaagaggaagaagacacatgagcacagtcttgaccaaacgctctcgcagatcggcacccttgagcagcagataaacgctatcgagtctgcaaacatcaacatggaaaccctcgaggccatgaagaaggcaggcaaggccatggaggacatacacggaaagcttacggtagagaaggtcgatgagaccatggacaagttacgggagcagaatgctctcagcgaggagattgtcaacgccatcacaaacaatcagctcggaaacgaggcaatcgacgatgccgacctggaggatgagctggaagcgatggaacaagagcaactggacgagaaaattctcaagacgggcacagggccggtatcggacgcaatccagcgcttaccagcagctgcgaatggagaactcaagggaaaggcaaccaccgtggaagaagacgacgaggaggcagagctcaggaaattgcaggcagagatggccatgtgacatgcgatatcaatctctctggggttctcgtcctcaaagcctcggtgcagcagtctgcagaggcagacattccatgtcacttcatctcggtatctcagttcttcgcgcaatcgcttcgtctgcttcgatttcattcgccacaatcacacccacccattcgtctggcatccttgtcggacaccgtacatttacctattggaagtttttttgccctgttcacagctgagggagtcttggatcggcgccatggagttttgcgactagacagtaatatcaagggttttgcatcccgaactggtgattgctatgcgttcggtggaatagtccagattcattcacagggcaggttgaacaaaggaggataattgatgtcttggaaaccacaccagtcttcctcgatggacaggtggaccgatatatcagcccctgaactatctctaagcctcgaggtcacgtggacccccaactcacaccacatcggctcaagatgaggacgaccc

SEQ ID NO: 490 - DNA, 3736 bp, Magnaporthe grisae
agctcacaggcgtgccccatatgaagtagtacctaaagagcggggtttcctcgcatcgcagcggtatctttttatcggcaagccggcccatcatgtgtcaacgctcgtgacgactaagcttggacgggggtttaaattggtgtgcgtgcccaccttcgtcgacggcacatggttatagcctaccttccaggggtgataacttattctcgtgatggctcctccccatcctcacctttcctatcgttcccctcgcggcctttgcatgttttagttgccatacacagcaacacttttgtggtcctttacttctctatctttcgtaaataccttacctatcatttttttctgcccaccctccctgcttctctctctatccctctctcactcaccccctctcttgcgtcctctcgttacttccgccttcgttctatgctccgctttcttattagtcgtcgtcttcctcgcatctccaatgcttgcgctcggcctggttcctcaggatggccaccatcgagccacggctaatgcacttgctgaacgacagtaagagcaatcatgatccaaacgaacttccgcctctacagtcgttcccgatccccaagggctcagctgtgcacgtgtcgctcccctcgctcagcctagaaatcgaacagcgtgatgagcaatttgccgtgaagcttccggccggaccgccactacaccacatacctccgttctcgacgttaaattccctcgacgataatgcttcggcgcaacacatcccgcccctgtctttggttgagtcatctgaggatacgccctcgtcccagcagatcccacctttctcgactttcgaaagtctcgacgatgcgcctcatcgatccggtcctccgaccagactcccaaaccccacctacgtctttgatgggcccgctcgaattccacaaacagccaaccagtcaatacgcgccctcctaggagattccagccctgtagagtcttcatctcactcccttcgcaaaatactcgacgacctgccgcccgagctaggtattcatgacgatgccacaaccaagaagcggcatcgggctttggccggcaaggaggattttgtgcaacttccacagcctctgaagaaacagaagtcggcacagcaggtcatgccacctataatcaatggccttcacgaaccaccacctaacgcggctgtatttcccccgatttcctcggtcgaattcagaaatggcgaccactcgctgagcttgagaccgctcaaagacctgggtcatattccagaggacaggcatgcaccggtcacgccgactgaagacaagacagcacaaccagctgtcaagaccagacgcaggaccaagcccagaaggaagtggacagaggaggagacgaatcatctgctgattggagttagtcggcatggggtcgggaagtggaccagtatattggaggaccctgattttcagttcaacgacaggactgccggtgatctcaaggaccgcttccgcacctgctgccccgatgaattgaggggtcagattaaccccggcgccggtgcaggcaagggaagggcttctcaggcagctaccacttcgcctacttatttaacagatacccaagcgagaaccaagaggactctgatgcttgagaatatcctcattgggaatgattctcagccggaacacgatgccctgaacatgagccctgcaaacgccacggcagccagcacgagcacgtcgcctgtctcttcgtcatcccagccccagccaaaagcatccggagatgcatcccagaaaccccgtaagagtcgagctcaccgaaaaaagcttgaggatcttgctgagcttggaatcagcggcccattcaaaaagtcacaccgacgcgagcgaagacccttcaccgaacaagacgacaaggaaatattggaaggaatccaccgttacgggccagcttggaccaagatacagagggatgaggcctttaatttgtcaagccgtcagccaaccgatctaagggaccgcgtgcgcaacaagtatccagatatctacgccaagatagagaagggagcgtttcagatcatcaaggagccaaacaacagtcatcgtaacaacctcatggagcccacggtgaacactaccattgagaattcgctcacctcggtgaacaaatcaggagggtcatctctagaagctcaactgaaccgtacaggttcaaaggaaaacctcccaaagtggtcgttgcagcactatgcacacgacacgtccgagacgagcacaacgggccaccacgaccaaccaggatcgtcactccctgggaactccggggaaatggacatttcgaggctcaagttgcttttccaagccacagcaaatgcttttcgaagcacggtttctggaatgtttccagtcactcaacatgggtgttaccatcctcagtattgttcttatgacgctgatctacaggcggacagtaagaagcaccagaagcgccttgccgcgccttcgcactggctgttggacaagctcagcggcacctacgcccccaagccctcgcccggtcctcacaagcagcgcgagtgcctgccgctcatcgtcttcatccgcaaccgcctcaagtacgccctcaatggccgcgagaccaaggccatcctgatgcagcgcctggtcaaggttgacggcaaggtccgcaccgactcgacttaccccgccggcttcatggacgttgtttcgatcgagaagactggcgagaacttccgtctcgtctacgacaccaagggacgcttcaccgtccaccgcatccaggccgaggaggccgagtacaagctcggcaaggtcaagcgtgttcagctcggccgcggcgggatcccattcttggttacgcatgatgccagaaccatccgctaccccgaccctctgatcaaggtcaacgacactgtcaagatcaaccttgacactggcaagatcaccgacttcatcaagttcgacactggcgccctcgccatggttaccgctggtaacaacatgggtcgtgttggtgttatcacccaccgtgagcgccacgatggtggcttcaacattgtgcacttgaaggatgccattgacaacactttcaccactcgtgagagcaacgttttcgtcatcggcactgagaagccctggatctccctgcccaagggcaagggtgtcaagctcaccatcgctgaggagcgtgaccgcaggcgtgcccagaccatcgccggccactaaactggtcgcgattgcactcggattggtttctgcatttggcttgggtgatatcaaaaaagaaggtcatgggtttacattacggtcacggagtccaggatggcgctttgtttttccatagggcatgatatgctagcttctaagtcgagagacttgttcactgattttcccctcttccagtgaggagagacgaggatgatgaaatgtccagtttaatgaagaaccatccggatccccatctagtgttgctgtcatgtgcgtggcttgttgcaatcagtgcgaactcttgctatgagtggtttaagcgaagcaagctactgcgcaggttaaaatagctcgaccgcttcagctgaggcgcctttacctaaaacaacaatcaatgttcctatctatcggcatgtagattggctccagaagcaagcagtaagtatgtcacaccatgaactcgacaaaatttacaaatccgcctttacccgagaatgacagtcggttagggctcttct

SEQ ID NO: 491 - DNA, 5638 bp, Magnaporthe grisae
cttgtctaccaaggtttgtaggactaaagtatcaaaactgtgattctaatcgacaccctgaggcgagaccgccccacatctcacagctgacgctagtacaaatcaggctagcgtcacagtcgcgtcgcctcgataccataatccacttcttcagaaagaacattccgcccttccttgacagttgttgccgcctccacaccatactttgtcaaccacgacagcgcggcgacgggtcaggtcatcgcgaaacctgtcgaaaccccacgaaaacgatctacatacaattccttttctttagagattctttggagactctaaacatcaccttggcgtcttctgggagcgcgcgcgaggttgcgctgtagcgggtaaagcctgcaccgcttgctttgaaatcagcttcagcttggcctcacctggattgataaggctacgcctcccaatcagcaagatttagaccaaataaaaaacgaacttgcgctcgtctttaagttttcaatatggcggaatacggcgagatggacgagtacgccgactacgaggccggcgattacgatgctgagaacgacgacgagatcacggccgaggactgctggaacgtcatctcctcctactttgacgaaaaaggtctcgtttctcagcagatcgactcgtacaatgagttcaccacatcaacaatccagggtatcgttgacgaatactcggttcttacgctggacaacccaaatcctcccgacacttttgaaggaaaacccattcgattgcgccgatatgaaatcatgctcggaaacattctcgtgacccagccgacggttaaggaaacagacggcaaggttagcactttggtgccgtacgagtgccgtgacagaaacttgacgtactcttgcccactctacgtcaagctcaccaagaaggtcaacgtcgcggtcgaagaggatataccgctacatgaactcaacgatgagcagcgcgaggagatgcagaggacgaacgagcaccccactaccattcgttgggagctggacagggacaagtcacacaacccggacgagaagatctcgggcgaaaagatggccgacatgatatacattggcaagattccagtcatggtaaagagtcgaatctgttatctcaggagtcagcccgagtcggaacttttccttctgaacgagtgtccttatgatcagggcggctactttatcatcaacggtagtgaaaaagtcctgatcgcccaggagcgatccgctgcaaacattgttcaggtcttcaagaaggcccaaccaaacaaatacctttaccaggcagaaatccgcagtgccttggagaagggctctcgccttgtctcaaccctgaccatgaagctgacctccaagggtgacagcacgcgtggatcatttggtcagacgatccacctgaacttgccatacaccagtggtgatctcccgatcgccattgtcttccgtgctttgggagtcgtctctgatgaggacatcctgaaccacatagtgttggacaagaacgacacacaaatgctagagatgttgaggcctagtattgaagaggctttctgtattcaagatcgagaagtcgcgctggacttcatcgccaagcgtgtcggcaaggatggtggccactcgaacagcaggcatcttcgtctgaaggtggcacgagacattctgcagaaggacacgctccctcatatctcccaggcagagggttgtgagactcgcaaggcctttttcttgggttacatggtgcacaagatcttgcagtgcgctcttggtcgtcgggatgtcgatgaccgtgatcatttcggcaagaagcgtttggacctggctggtcctctgctagccaaacttttccgtggtatcattcgcaagttgacaaacgacatgatgggtggtctgaggcgatgcatcgacgctggcagagattttgatctcacagcctcgctcaagcccaacactctgacaaatgggttgaaatactcgttggccacgggcaactggggagatcaaaagaaggctgctagctccacggctggtgtctcacaagtgttgaaccgatacacttttgcttcgaccttgtcccatttgcggcgaaccaacactcccattggaagagatggcaagcttgctaagcctcgacagctccacaacactcattggggtctcgtgtgtcctgctgagactcccgagggtcaggcctgtggcctggtgaagaacctgtcgttgatgtgcatggtcagtgtaggtactccggcagagcccatctacgacttcctggtcgcgcgaggaatggacgtactcgaggagtacgagccatcaaactcttcaagtacatcaaagattttcatcaatggcacgtgggtcggtgtagcaaacaagattgaagagttggtagacttggtctacgatcttcgcaggaagagcagagttgaccctgaagtatcacttattcacgacgtccgtgaaggcgagttcaggattttctcagacgccggccgtgtcatgagacctttgtttgttgtcaaccaaaaggatgacccacggacaggtgcccaggcgggcagtctggtgctcaccaaggagcacgttgccaagctgcatgcagacaaggacaacaacctcagccctggagacgagggtcactacggctggcaaggcctgaagagtgatggtgttcttgacttgatggatgctgagcaagaagagacggccatgatctgcatgtcaccaagcgatctagataagttcagagcgctcaagtttggcggtgcaactctggacgagttggaggcctttgacaagaacgatatcaacagaagattgaacaccaagatcaacccgacaactcacatgtacacccactgcgagatccaccccagtatgcttttgggtatttgcgcaagcatcattcctttccctgatcacaaccagtcaccccgtaactgttaccaatctgccatgggtaaacaagccatgggtttcttcctcaccaactacaaccgccgtatggacaccatggccaacattctctattatcctcaaaagcctcttggcacaacccgatccatggagtacctcaagttccgtgagcttcctgccggtcagaatgcaattgtagcaattgcctgctactctggatacaaccaggaagattccgtcattatgaaccaaagcacaatcgatcgcggtctgttccgtagtttgttcttccgttcatacacagactcggagaagcgtgttggtatcaacatggttgagaagttcgaaaagccgttccgtgcggacacgttgaggctcaagcagggcacttacgacaagctcgaagacgacggcatcgttgctcctggtacccgtgtttctggcgaagacatcatcatcggcaagaccgctcctattcccgcggacaaccaggaactcggccagaggactgtgcagcacacgaagcgtgacgcatcgacccctctccgcagtactgaaagcggtatcgtcgaccaggtcatcgttacgaccaaccaagatggtctcaaatacgtcaaggtgcgtgtgcgaaccaccaagatcccgcagatcggtgacaagttcgcatccaggcacggtcaaaagggtacgattggtgtcacatacagacacgaagacatgccattcaccagggagggtattactcctgacattatcatcaacccgcacgccattccatctcgtatgacaattgcccatttgatcgagtgtttgttgtcaaaggtcgcaacgctcaagggtatggagggtgatgccaccccctttacagaggtgacggtggattcggtcagcaacctcttgcgtgagcatggataccaatctcgaggctttgaggttctctatcacggccacactggtcggaagctgagagctcaagtcttctttggaccgacatactaccagcgtctgaggcacatggtggacgataagattcacgcccgagcacgtggtcccgtcaacatcatgacaagacagccagtggagggtcgtgcgcgtgatggtggtctgcgtttcggagaaatggaacgtgattgcatgattgcacacggagcagcctccttcttgaaggagaggttgtttgaggtttcggatgcgttcagggcgcatatctgtggtatttgtgggctgatgacgcccattgccgatctcaccaggaaaacattcgagtgtcggccatgtaggaacaagaccaagatcgcgcaggtgcacataccgtatgcggccaagctgcttttccaggagctggcgtcgatgaacattgccactagaatgtttactgagagggacaagaaagaaacgtacagctttttcggctttttgctgaaagtgcacaaatatcaccgtcgtggcggcaaagagcgaggtgctcagcaggtggcctggctacctgcaccagtgcattcccaaccccgcgacgaaatcgcgtcccgggttaacgcgtctggcaaagaatggaatgatgtaattttctgccgtcccagaccacacgcaacccggccggcgttcctttcatccctgcagcggcgtcggctcgggcttggcgcttgctttggggggcagctccaagaccaaacaacatcaacttgccatcctaatacatccatatctcgccagccgcctactgtaacaacaccggggcaggttaacccgtcaattcgatctctgcagcctgcgacttccttaccgaggccttttgcgacaaacagaattcacaatggttcgtcggatgcaatcgcccaccgcagcgtccacggtagcgaaggagacaccaaagctaaccattcgattcccaacagtctgctcaaagttcagcgggccgagcgtgaggcgtccaagattgtccagaaggtccgcacaaagagagtaaaggaggcccgcgacgaggccaagaaggagatagaagcctacaaggctgagaaggagggcgagtacaaggcatttgagtccaagcacacccaaggcaacaagcaggccgaggaggaggccaacaaggaggccgagaccgagatcaaggagatcaaggaggccggcaagaagcaccaggacaaggtcatcaaggatctgctcaaggccgtctttgagcctcaccctgtgccgccgactgctgcttgagctgtttgtttgaagaaaccagttggcgtcatgttttttgcaccgagcttatagaaagatgaatcaagcagcatgttgcaagattgtccattgagagtagttgtagtatgcatcaacgcttttggctttttttttcttctttttttcgttctataaatctttacgccaacttgtatgccgctatgaaaacattgatatacacattaatcaaacaccagacaactgcctccaaacagttaatcttggaggaattcccgaagtgtcgtcagcatatcatgcatctccttcccattctccgtctccacatcgacggcatcagcttgttcctttaagctctcactcagcagctccaaagtctcatccctatccgccaggagcgtctgaatcttcctctttgccccgtcgtcctccgccaccaaccatgcgaggatgacgtcgatgctctgcaacacaaagagacccgcgtccagccggcgcgagaaccgctcgtcttcgtccag

SEQ ID NO: 492 - DNA, 3463 bp, Magnaporthe grisae
ataggtgctgagtgatgagcacaggttgtacatcttttaggccacctttgcgagtctacctacttctgttcgtacttgaacttggtggggcagagttgctaatccgccacaagtggccaaaaatctgtggctgaacggcttgctcggaaccactttgggtggtagggaagctccgaccacgtacccagaccagccagcccaggtatcaatcgaagagctaggtaatcgtcatcagtagaagcctagtagctagccctggaccttttcgactttgtacaaactttcagctttctttcaaacccctacctccaaccatcttcaaccacagacatttcaccactgatcataataacgactacgaaaactcgcctgccgttgaaatttcgacgctgggcattgcaactacttattcccagcgcaccaaaccccgctctcgagaactcagggtattccgacatttccaaagtccgttttgagcacgctgctctttcgtagacaagatgtctgccgacccatcacaggaccctcccaagaagaaggtcaacttggccgatgtatctggcgccgatgtcaaggaggagtcggatgtagcaaccgcaattctgaaaaagaagaagaagccgaatcagttgatggttgccgatgccacaaacgatgacaactccatcatcgcactctccaacagcaccatggaggctttacagctcttccgtggtgacaccgtccttgtgcggggaaagaagcggaaggacacagtcctgatcgtcctagctgatgatgagctggatgacggaagcgcacgactcaaccgtgtggtgcgtcacaacctcagggtcaagcatggagatgtcgtcactatccacccttgccctgacatcaaatatgccaaacgaattgccgttttgccgattgccgacaccgtagaaggcttgacaggctctctgttcgatgtcttccttgcgccctatttccgggaggcctaccgcccagtccgccaaggcgatatttttttggttcgtggtggcatgcgtcaagtcgagttcaaggttgttgaggttgatcctccggagtacggtatcgtagcccaagacacggttatccactgtgagggcgagcccattcagcgtgatgaggaggagaacaacctcaacgaggttggctacgacgacatcggtggctgcaggaagcagatggcacagatccgtgagatggtggagcttcctctgcgccaccctcagctattcaagtcgatcggaatcaagcctccacgcggtgtcctcctctatggacctcctgggaccggaaagacgctcatggcccgtgctgtcgcaaacgagaccggtgctttcttcttccttatcaacggtcccgagatcatgtcaaagatggccggcgagtccgagtcaaacctgcgcaaggcctttgaggaggctgagaagaactcacccgcaatcatcttcattgatgagatcgattccattgcaccaaaacgtgagaagacaaacggcgaggttgagcgccgtgtcgtttcccagctgttgaccctcatggacggcatgaaggcgcgttccaacgttgtggtcatggccgcaacaaacaggcctaactctatcgaccccgccctccgccgttttggacgtttcgatcgtgaggtcgacattggcattcctgacccgaccggtcgtttggagatcctccaaatccacaccaagaacatgaagcttggagatgatgtggacttggagcaaatcgccgctgagacgcacggttacgttggttctgatgttgcggccctttgctcagaggcagccatgcaacagattcgggagaagatggatctcatcgacctcgatgaggacaccattgatgctgaggttcttgactctctaggtgtcaccatggagaacttccgctttgcccttggcgtctccaacccttcggctctgcgtgaggttgcagttgtcgaggtgcccaacgttcgctgggaggatatcggtggtctggacgaggtcaagcaggacctcagggagcaggtccagtacccagtcgaccaccccgagaagttcctcaagttcggtctctcaccatcgcgtggcgtgcttttctacggtcccccgggtaccggaaagaccatgttggccaaggccgttgccaacgagtgtgcagcaaactttatctccgtcaagggtccagagctgctcagcatgtggtttggagagtcggaaagcaacattcgtgatatcttcgacaaagcgcgcgctgcggcaccttgcattgttttccttgacgagcttgactcaatcgccaaggctcgtggaggctcggtgggtgacgccggcggtgcatcggaccgtgttgtaaaccagctgctgacggagatggacggtatgacttccaagaagaacgtgttcgttattggagcgaccaaccgtccggagcaattggatcccgccctttgccgtcctggacgtcttgactcgctcatctatgtgccgcttcctgatgagctgggccgcctcagcattctcaaggctcagctgcgcaagacgcccgtctcagatgatgtcgaccttcagtacatcgccaacaagacgcacggcttttctggtgccgatcttgggtttatcactcagcgtgctgtcaagatcgccatcaaggagtccatcacggccgacatcaaccgcactaaggctcttgaggctgcaggcgaggatgtccccatggacgaggatgccgaggaccctgtccccgagttgacgaagcgtcactttgaggaggccatgcaacaggctcgcaagtcggttagcgatgtcgagatccgtcgctacgaggctttcgcccagcagatgaagaatgctggcccgggcgccttcttcaagttccctgaaggcgagggtgcaccggcagccagcggcggcgagacattcaacgacggtggtaacgacgatggtctgtacgactaagctctccaatctcatcttcaatacaactcaagcctctgtacactacacctttgcttcattcaacgggattttgacatgactgagcccggcgcggccagggaataacggtatgcactgggctcggccgttttgagatttgttgacttgggcaatgttcgttcgcggtcttatacgctggtttcatgatttctagaacaggtgcgatggaataggtagattcgctggattcgcacttgctggaggaggccacagcatagcctcagggaatgattgaaatattactaaagaccgatttctattggagttctcaattgcaagggtttagatggattaatattcttggaaagcctccgggctcccctatcatgaacctgaatatccaagtccttgatcgtccgtcctgctgcgtgatgatgtgagaggcgatagacagcgtaaacccaaaccatatctttggtaacgccaatcacctgtcgccttgctgagtacaaccagactgc

SEQ ID NO: 493 - DNA, 1651 bp, Magnaporthe grisae
ccaaaatgcgctgacgtctgaatgcgctgacgtctgaatgcagatagttgatataggtcacgtgatactgctaccccgccactaggctgccaacgagtttttcgctggtcaggcttttgggctgggattgtctttcgggaaaaaaacaacatcaaaaaaaaaaaaagctcttctaatacattccgcgttctgaagtatccgttcttttctcgatacaaagtcttcacatagccatcacgcgcaggtatgtgttcgctcgcttcttgcttccgattgccccgcttccaccaggttctccgcctcaagttctttgggttgctttgtggctggtagtcttcacgctagagcaaaacccccccaaaaatcgacatcttgtccctccttcctccaatacaccagttaactcaactgacatcgcgcgccgcgtctcacagttttgcgacgataccacgagcgaaactagacttcttttatcctcctcacacacaaacatcacaactatggccgaggctcagcaagtccccaccttcaagctggtgcttgtcggtgacggtggtaccggaaagaccaccttcgtcaaacgccacttgactggtgagttcgagaagaagtacatggccacccttggtgtggaggttcacccgctaggcttcgagacgaactttggcaagattcaattcgatgtgtgggacaccgcaggccaggagaagttcggtggtctgcgtgacggttactacatcaacggccagtgcggtatcatcatgtttgacgtcacatcccgcatcacctacaagaacgtccccaactggcaccgtgacttggttcgtgtgtgcgagaacatccctattgttctctgcggtaacaaggtcgacgtcaaggagcgcaaggtgaaggccaagaccatcaccttccacaggaagaagaacctgcagtattacgacatctcggccaagtcgaactacaacttcgagaagcctttcctgtggctcggccgcaagcttgttggcaaccccggtctggaattcgttgccgcccccgcccttgctccccccaccgccgaggtgaccgcagagcaggcggccgcgtacgagaaagaccttgcagatgctacgcgtgcgcccctgcccgatgatgatgatgaagacttctgagcggtggatgactgctagccctcgcgcgaggattctaatggaagcgcatggtgaagctggggttttgccgttctgggtctctttgtatagaaacactgagctcaagcggtaggctgactacttacgacgattatgggactgatgggagggaaaaggttgcacaaggactgcctctgaaggaaaagtgagcaaagtttcggaataggattttacatattcgtgaccggcacatccactcagcatcggcccttacgagattcacgacacggtggtagaaatcggcgccagttactgcattgtgaacagcttaggtagacactaaaattttcagctgactggtttctttggcggaacactttcggggattttgcatacctgaccaaacgcagcgaccatggcttttgagggacagcagaagtataggctcgctgagttgaaagaacacaagcatgtggagtagacaaaagcagcgagcagagtgaagagatatggtttattag

SEQ ID NO: 494 - DNA, 3313 bp, Magnaporthe grisae
aaagactccaagcgtttaagaagtttccaagaataaagaacttacataccctaaccccgcagaggtcattcgaaataagttgtgccccaccaacaacacagccactgacaggggcctggggtccagagtctagactaatgaactagccacaatgtgtgttcctcgagccgtgcgacgccttggaagcttgcttgctcgaggtgtggtgtcctttttggcgaggggccagcaaacagctccagattattagacgagcatccaactccggactgtctattttctatctaccaacttatttatctcacgcatgtagacctaccatgacaccctgaacctttgagccaaaaatcaagaaataagtcagtctggtcaacatcacgcgggcatcacgcccctgcatttcaagaccggtgcataccgcaagctatagccgctatcgcgccaacccgtctaattctccaccgactcttggaggctgcatataaccagagcacgccaccatggattatgaaaacctgaaggaacagtggagcgaggttgaggatcgcgatggcgtccgcctcagctggaacgtctttccgagcacgcgcatggaagcgtctcgcctcgtcgtcccgatcggtgccctctacacccctttgaaggagaagccagacactcccctgctgcagttcgagcccgtcacctgcaagcagccatgccgttccgtcctgaacccattctgccaggttgatgttcgtgctcgcctctggatctgcccgttttgtctctctcgaaaccctctgccgcctcactacaaggacatcacggccaacgccatccctccagagctgcacccatccaataccacaatcgagtaccgcctgtcccgcccggccccgagtccgcctatctttctctacgtggttgatacctgccaggaggatgacagcctcaacgctctcaaggagtctctcgtcatgagcctaagcctccttcctgagaacgccctcgtcggcctcatcacctacggcacaatgactcaagtccacgagattggctacaccgagtgcgccaagtcgtatgtcttccgtggtagcaaggactatgcgccgaagcaggttcaggagatgcttggcctcggccagatgcccgtccgcccgggcatgcagccccagccgggacgcccgatgcctatgggacccgcctctaggttcttgatgccggtttcccagtgcgagttccaacttaccaaggccttggagcagctccagaaggacccatggccagttgccaacgataggcgaccgctgcgttgcactggcgtagccttgagcgtcgctgttggtcttcttgagtcttccttccagaactctggtggccgcatcatgctttttgctgccggtcctgccactgagggccccggtatggttgtcagctccgagctcagggaacccatgcggtcgcatcacgacattgaccgtgacaacatcaagtactacaagaaggctctcaagttctacgacactctggccaagcggaccgcccataacgggcacataatagatatctttgctggttgccttgaccaggtcggtcttctggagatgaaaggtctcagcaactccacaggtggtcatatgattttggtcgatagctttacgtcgtccatgttcaagcagtcgttcgtgagggtattcgaaaaggatggagacgacaacctgctcatgggtttcaacggtatcttggaggtcctgaccaccaaggagctcaaggttacaggtctgattggtcacgccgtctcgatgaacaagaagtcgacctctgtcggtgagaccgagtgcggtattggcaacacgtgctcgtggaagatgtgcggtattgacccaacatcaagctacggcatctacttcgaggttgcacaaggtggcccgtcacacgcccaaccagctcagaaagggatgatgcaatttctcacatattaccagcactcatctggacagttccacctgagggtcacaaccattgcccggaacataggcggtcccgccggagatccggcgattgcacagtcttttgaccaggaggctgccgcagtgctcatgtcgaggatcgcagttttcaaggcggaagtagacgacggaccagatgttctgcgctgggtcgacaggatgcttatcagtctctgctcaaggtttgccgactacaggaaagacgacccgtcatctttcaggctcgagaagaactttactctttacccgcagttcatgttccacctgaggaggagtcagttcttgcaggtcttcaacaactcgcccgacgaaactgccttctaccgacatgtcctcaaccacgaggacgtgagcaattccctcatcatgatccagcccacgctggatacatacacgtttgaccaggaaggtggacagcctgtgctgctcgactcagcctcgatccagcccacgcacattctgctgcttgacaccttcttccacattctcattttccacggcgagaccatcgcacagtggaagaaggccggataccaggaccaggagggatacgagaactttgcccagctgctgcaacagccaaaggaggatgccatggagctcattacggaccgattccccttgcctcgtttcatcgtgtgtgacgcaggtggatcgcaggcacgtttcctgctctcaaagctgaatccctcgacaacgcacaccaccggcgcatacggtggcgtgggtgcacaaacggcacagaccatctttacagatgacgtttcgctgcagacttttatggaccacctcatgaagttggctgttagtggcaccaactagtagtcggatcaagcaggtaacttgtaagcagtgatgcgatagggtcccaggagaaagggagtggacaaagcgatgatgactatgtgttagttctttttgtggaattttcaaaatggacagcgccgttggctttaccgagtagacgggggctacagtgccgcaaattttatacaactgatgaatccttccatggtagctagccgtcattggtgtgagtatggtgaggacgggctcaactttgagattgaatggcggagcgagtgggtcatgtccctttgggcaggccattgcaagcgttggaaagcctcccagccgcttgcaacactcttaacgttccaagattaaaagtatttataaacgggctctctgacatcttcaccagcgtcatcgtcatagacgatttcgtcattatggtgttggttattcgtttcacccgttacaaatcagcatggtaaaggtcaatggttatggtaatgattaattctgcttgcgcgtggtgt

SEQ ID NO: 495 - DNA, 1564 bp, Magnaporthe grisae
gggacgagtcctcggcaggttgtcagctcgattatttactaacttgaccttgaatggcaggcgagcgaggcaatgagatggctgaagttttgaaggatttccccgagcttgagattgaggtcgagggccgcaaagagccgatcatgaagcgtaccacccttatcgccaacacatcgaacatgcccgtggccgcgcgtgaggcctcaatttacacgggaattacagtagccgagtacttccgtgaccagggcatgaacgttgccatgatggcggactcttcatcccgttgggctgaggctctccgtgagatctcgggtcgtcttggtgagatgcctgctgatcagggtttccctgcttacctgtctgccaagcttgcttccttctacgagcgtgctggaaaggtcaacgccttgggctcacctgagcgcggtggaagtgtcagcattgtcggtgccgtcagcccgcccggtggtgatttctcggatcctgtgactacatcgaccctgtccattgtccaggtcttctggggtctcgacaagaaactggcacagcgcaagcacttcccgtccatcaacacttccctttcgtacagcaagtacacgatgatattggagaagtggtacgagaaggagcaccccgacttcccacgtctgcgtgaccaggtcaggcagctgctgtcagactcggaggagctggaccaggtcgtgcagcttgtcggcaagtcggcgctttcggaccccgacaagatcacacttgacatggccacgctgctcaaggaggactttttgcagcagaacggctacagtgactacgaccagttctgtcccatctggaagacagagtggatgatgcgcctgatgatgggtttccacgacgaggcgcagaaggcgattgcacaaggccaaagctggagcaaggtgcgcgaggctacccaggacctgcaggccaagctcaagagcctcaagttcgaggtaccgaccgacggcgaagaggttatttgcaagaagtatgaggccatccgcaacgaaatgctggaaaagtttgcatctgtcatggacgagtaaggtagagagatatcggaccttgtctagtttgttgttaagttgcacaagcggaatggaagagatagtgtgcgtatatagaagtaccaagatacattttttttacttatcggctctgcgatgatgtacttgatcatgagcttccccaagacgtgtataagactgactgaaatgcaactcgaccgcattttgatgcatgaaagtctgtcggaacttattcagttcaatgtgatcaaatgagcagtagggcgatcagtcaaatttgctttattgcaagtcggtattttgctatcagccatgtgacagttaaatatattacctaaaccgcaacaaccgctaatttgaccgttatccgcacagttgcaaggaacatggctcaaggttcccttgtgtatgatggtagacttgacaacaacaccgcattggtaattaaacatataatgcaaagaagaaaggaagcagaggaagaagaaaggttaacagaaaaagaaaaacaatacgag

SEQ ID NO: 496 - DNA, 1585 bp, Magnaporthe grisae
gattacaatccccacaatgaacaaacagcccggctcatccgtctgtcaataaaattccaactcaatgtgttggatagagagaaaacggcgtcagagtttagcagtcttattccaattcggcagcggactgagacccgactgcatgtcccgttgcctatcaccaccgctgagtcggggctgggaagaagggagtcgtcattggggaagctaacaagccacaggttggagctcaaagtgggtcgccgaggccccaccttcgctcgaccagtggactcgttatccaacgcaccctggacggacagacagaaagcccaaggactgtccacgtgacgtgaagttgaggggcagtttgaacgtgcgcgaaaaaaccggggcaatttttcgaccgcacacaagaggtaatttctcatagccatcgaaacaactgaagtttgccctgcagagcaaccttcacgtcgccatccaagtttctcccctccgaccacgaagacgccgtcaagatgaagtacatccactcagaggagctcctggaggtgccggagggagtcaagatcagcatcaagtccaggctgattactgttgagggcccccgaggaaagctcactaagagccttaaccacatcgccgtcaccttctcgcaacccagcaagaacgttatcggcatcgagattcaccacggcaagcgcaaggatgtcgccaccctccgtaccgtccgcaccctgatcaacaacttgatcattggtgtcaccaagggctacaagtacaagatgcgttacgtctacgcccatttccccatcaacgtcaacgttgagaagaacaacgagactggcaacgccgaggtcgagatccgaaacttcatcggcgagaagctcgtccgcagggtcgccatgcagcctggtgttgaggttgagatctcaaaggcccagaaggatgagctcatcctgtccggtaactctgtcgaggctgtctcgcaaagcgccgccgatatccagcagatctgcaaagtacggaacaaggatatccgtaagttcttggatggtatgtacgtctcggagaagggcaacatcgaggagattgctgcataaatgggggtgcgagtcgactgctttctttgtgctttcctctgggtctaaaggagtggcaatgggttcatcaacggagttgcatgttatgcgatggataaagtctcatagtaaatgtgagcaaaaagatctttttttcggccacaactgtgcgacgcccgctcgcgacgcatcgttttctagggcatctgagcataacgagataccacccatgaatgagcctaggtacggacttggtgaccgtgactaaggattcacgggggcttgaactagcagagcattggttctatgccgactggatggggcgcaacgctttacgattaatgtacaaccgattttcacttttgatgaagagaatggcttgtggaaattattcgtcgttgccatcatgagtcctcgccccatggctttctgtgtcatataggatctggctttgtcaaataggattcccatcctgtccccatctttttgaagccccaaagcctctgccaataaataagata

SEQ ID NO: 497 - DNA, 2008 bp, Magnaporthe grisae
gtcgcaaggaatgctttgtggagtgaggctgaagtgagtagtatatggaatgaatgacctcgttaacgaattgaaaaggcggcgggatgatggaattggcggctgcgcgtggagaagcagttgctatcggagcgagcttctgatgcgatactgccacgctagctctgtttgggcaggtggtgaagatccggcacgtgctgattagaagctcgagcagataacagcccacccttgctccagctcccgcctcgaagaagctcaggttgaatttaggctttggtccgtgctccacttccaggctgcgtaggagctgcgtcaactggacattgcccgccatcttgaatgtgcgacctgacaaacacgatttcaaaccaccacttcatccgccactcccatcgcaaacagcgcgatcgcaattatttacgcccccaaccgacagtccgatctagcgaagagtccgtgaatccaaacaacagctgcgttgtgccctcgcagccaagatggaacgcttccgaagtatgatgaacggtatgggcggccagcttggcgctgcccccggaacgttgatcgacaacgccgagaccgtctatatttcttcccttgccctcctaaagatgctgcggcacggccgcgccggtgtgcccatggaagtcatgggacttatgctgggcgagtttgtcgatgacttcacagtacgcgtcgttgatgtttttgccatgccacaaagcggtactggagtcagtgtcgaggcagtcgacccggtgttccagatgaagatgatggatatgttgcggcaaacaggaaggcccgagtccgtcgtgggctggtaccactcacatcccggtttcggctgctggttgtcgtcggtggatatcaacactcagcagagtttcgagcagctcacaccacgtgccgtcgctgtggtcgttgacccgattcagtccgtcaaaggaaaggttgtcatagacgctttccgtctcatcaacccgcaatctctcatgctcggacaggagccccgccaaagcacatccaaccttggccacctcaacaaaccctcgattcaagcattgatccacggtctgaaccgccactactactcgataaacatcaactaccgcaagacagcgctcgaggagaacatgttgatgaaccttcacaagcaagtatggaccgagtccctgcagatggatgatttccgtacccaaggacagaacaacaaggagcgcttggaccggctggtcagcttgtcagaaggttacgagaagcgcgtgaaggaggagacggagcttaccaaggaccagctgaagacgcgctacgtcggaaagctagacccgaagaagcatttggaggatgttggtcagcagctcatcgaggacaacattgtcgccgtatcaaggcagatgattgacaaggaggctgcggtgctggagaagaaggcgtctgctgttggagcaagcggcaaggggcgttcagaggacgatcaaatggatgtcgaggaagacctatgagttcccttgggattaccagcttctttgacaggcatcaagacgtttgctaggcaaattagaggcgcacacaaaaggatgccaaccatctcgatatgcgagctatcagggccgcctgagcggcagatacgacgtccaattatgacggcatgtactagtagggtgggcggcgtttggttggtttagacacagcctattagatagcgccagcatatcgcgatgcgcaccgaacatgttccggtcagtcccggaaacacctctttcaccttcatgaatcatgccctaggtgcactgaaatatgcagtgccagtgctatgtcggattcattggcttggcagccacaaagatttacagaagttccgtctttgtctggatgttggcaagtgacaacacaaaggcgtagtatgcgggttctttgatgacctcgagccaatgtacaaggccattgtctcattgtgggcggtcaaagacgaatggagcataaaataagggatttggtcctc

SEQ ID NO: 498 - DNA, 2827 bp, Magnaporthe grisae
atccgcagtagttccgtttgtacccaacatgatctcaacctcgggtatcttcgccgaggataagctgtctggcttgacatgctcgaaaacggcgacgctgctttccatataaaagccctcttctgcatcatcgggaggtatcccttcagttgagtcattccccccttcgttctcgtgttcctcgggttgcgtgccttcgaggtcgaggccgggcggatcgtgcctatcctcggtcaccaattcgtcgccgtcgaaatctattccccctaggtcttgctcctccaaatcggtatggtcgcctccgctttccatgtggcttatctcattgagttcaatttcgccatcgatatggcccggatgggcagtggtgagcaagtccacagacatagcggtgcacagccgtacacgtcaaatccctagtgcgggaggcaaataattcgcgttttgcacgataaccaaagcaatgaacagtattcggtactaggccgtatctgtccctaatgggtatcgttgggctcgttactgccgacagaggccagatgggtgcaaacaagtcggctcagttgaatacagttcaggaactgtgcagactcggacgtggtctggcctttattggcagatggctggtaggggagttgctccgcggtgatagaactgcccccctttggtatgcaagccgcatattgaattcgcggcctctcgttcgcgatagtctgtccatttcatattcccgagcaccaatcagcaagacatatacagacaaccccaagacaactgcgaaaatggtggtcctcgcagcttcaatctgcactcgcggcggcaaggctgtcctgtcgaggcagttccgcgagatgccccggtcgaggatagaagctttgctcgcctcgttcccaaagcttgccgacagtggtacccagcacacgaccgttgagcaggacaatgttcgattcgtctaccagcccctcgacgagctctacatggttctcatcacgaaccgtcagtccaacatccttcaggatatcgactccctgcaccttttcgcacaggttgtgaccagcacttgcaagagcttggacgagcgggagattctcaagaatgcctacgaactccttagcgcctttgacgagctggttactctgggctacagggagaacttgaccattagccagatcaagaccttcctcgagatggagagtcacgaggagcgcatccaggagattattgcgaggaacaaggaactcgaggccacggaggagcgcaagaggaaggccaagcagctggagatgcagcgtaaagagtctgctcgcagtggtaggcccggcggcgcacagagagcaccagtctacccgacatatacacctccgtctcgccctgcagtcacagacacctatgacacgtacgaggctgagaagaacaagtcaaaattcactgcaccaaagggcaagggcatgcagcttggcaagaaatccaagacgacggatatgttcgagcgggtgcgcggagatatgggcaacgagatcgacgatacgccgcttgttgctcccacagcttccgccgcacccctcgcttcggagccgccgcgccggcaatctgttggcacggaccgcgattctatccatatcaccgtatcagagaatattactgccaagatctcaagggaaggcacactaaattcgctgggtgtcaagggtgacttgaacctgcgggtatcggacccgacgatgaccaagatcaaactgcagcttgtggccaacccgacgcacggtgcccaattccggacacatcctaacgtagaccgcaaccttttcaacagctctaaggtcatccaaatgagcaaggctgataggggcttccccgtcaacaactcagtcggtgtgctgaggtggatggcgacgccgaaggcagacgacactagtgcgcttccgatcagcttcaccgtctgggtcaacaagggctctgatggaaactgcacattaacggtcgagtacgaactcactggaggagacgagctcagggacgtcagcgtctccatcccatactcgagcacagagccgacggtgtcgagctttgatgccacgtatgaggtgtccggagacaaccttgagtgggcgattggcacggtcaatgaggagaatgccaatggctcatttgagtttgaggcaatggccgacgatgaaaacgagtttttcccgatgcaggtccggttctccaagacgaccccatttgttgacgtggatatttcgtcggtgacgctccttgaaatgaacgaggaagtcactttctcaaaagacgtgaggtgtactgccgacacttacttgatcgaatagtcggatggttttggcctgggtgtgtgtttttggaggccggcgcttggagtcttaagaattggtcgacaaaaaggcacaaccggtttatcggcctgtccagatagaggtagcaagataacataaaccttggattacgtatggcgccttgagagaactaaggtttatgtgtcctttcaatcccatgttatgatctgtcctggaaggttaggcctgcatattgtggctcgctgcagactgcggcaaagctctcctcctgagattttgcggcaccaagagaaaacaacaagctaacaggattctacacggccagacacgggatgctactcaacaacaatctagctttcgaccgccatttcaaaacattccgaagacgtcgtcttggatccctgcccttcctctttaccaacggcacgatgctatcgggttgctgccgtcattaccgccatcacataccatagctccccacaactcgggatcgccataaatataagccctgatga

SEQ ID NO: 499 - DNA, 1842 bp, Magnaporthe grisaee
gccaatgagctcttcgcctgggtctgttttctcttttttactacattttcgagcagtttaacgcaacatggaacggtttgtgatggacggggaaaggggtctgatatctcttttttattctccctcatcataccagggacggcattgaaaaaaaggaagggggaacaaaatgcaatgatgtccaagctgtacatgaggttttttatatgctcaaatgtggtctggttacgtcggtttcacctggccgtggcgtgtatgaggaaacgatctgggtacagcgtggcttgactgaatgttatagcaccttgacagcttcgtgtgaatgtgaattgcgttggaaccagatgtttgaattagtttgtgagcatcagggggctgtggggttctttatatttgcctacgggtgaaacttttcaccagagttatctcctgccacagcaagtccccaggtcacagtcactgctattacttgaatgctttctggcagatatgaacactatatgccagggtacgactctcgttgtctccacgtagatatgagaattcaagagttccccgagatcggccattcatctcttaaacgatctccagcagggacatgtcgtcaagctcccagtgcatttctgcagggtggaagagctgttgcgaagacgactggatcagaaggacaatttacagagattgctagagtggtgattgcaatcatgtcattaccggcaatgaggcaggcggcttcgagggcgctgaggatgcgtgggcccgtgggccggcacgtcaggatggtgtcgacggcttcgcatgagagccagcagaggctgctctcctcgcacctgcaaaccgcagacccggccatgtacgatattgtcgagaaggagaagcagaggcagaagcactacatcaacctcattccgtcggaaaacttcacatcccaggccgtgctggatgctttaggaagcccgatgcagaacaagtattccgagggttaccccggggcgaggtattacggcggtaacgagttcatcgatcaatccgagaggctatgccagcaaagagcattggagacttttggtttggatgacaagcagtggggagtgaacgtgcaagctctctctggcgcccccgccaacttgtacgtatactcggccctcatgggcgtccacgaccgcatgatgggtctagacctgcctcacggcggccatctttcccacggataccagacgccgaccaagaagatctcgttcatctcaaagtactttgagacggtcccctaccggctggacgagtcgaccggctacatagactacgacaagctggaggagctggcacacatctaccgtcccaagatcatcgttgcgggcacctcggcctacagtcggtttatcgactacaagcgcatgcgtgagatctgcgacaaggtcaacgcatacatgctggccgacatggcacacatctcgggtatggtcgcggccaaggtcatcccgggaccttttggctacgccgacattgtgaccacgaccacccacaagtctctgaggggccctcgcggtgccatgatcttcttcaggaagggcgtgcgttcgacgaaccccaagaccaaggctgaggtcatgtacgaccttgagaaccccatcaaccagtccgtcttccccggtcaccagggcggacctcacaaccacaccattgcggccctggccgtggcgctcaagcaggcgcagatgcccgagttccgcgcgtaccaggagcaggtcctcgtcaacgccaaggcttttgcccgccgtctgggtgaggccaagggcaacggcggcggtctgggatacaagatcgtctcgggcggcacggagt

SEQ ID NO: 500 - DNA, 24 bp, Artificial
  Primer
tgactccgagggccacgttggtct

SEQ ID NO: 501 - DNA, 24 bp, Artificial
  Primer
gctcctgatgagcttggtctcctt

SEQ ID NO: 502 - DNA, 26 bp, Artificial
  Primer
gtctcaagaacaagcgtgaggtctgg

SEQ ID NO: 503 - DNA, 21 bp, Artificial
  Primer
gccttctttctgcggacacgg

SEQ ID NO: 504 - DNA, 21 bp, Artificial
  Primer
catcttggggctgcgatcaca

SEQ ID NO: 505 - DNA, 23 bp, Artificial
  Primer
gattgcctcgtttccgagctgat

SEQ ID NO: 506 - DNA, 20 bp, Artificial
  Primer
gcaaggtccgcaccgactcg

SEQ ID NO: 507 - DNA, 23 bp, Artificial
  Primer
gcacaatgttgaagccaccatcg

SEQ ID NO: 508 - DNA, 24 bp, Artificial
  Primer
cctcttgcgtgagcatggatacca

SEQ ID NO: 509 - DNA, 26 bp, Artificial
  Primer
cgatcttggtcttgttcctacatggc

SEQ ID NO: 510 - DNA, 23 bp, Artificial
  Primer
ggagcaggtccagtacccagtcg

SEQ ID NO: 511 - DNA, 24 bp, Artificial
  Primer
ggtcgctccaataacgaacacgtt

SEQ ID NO: 512 - DNA, 24 bp, Artificial
  Primer
gccagtgcggtatcatcatgtttg

SEQ ID NO: 513 - DNA, 23 bp, Artificial
  Primer
cttcatcatcatcatcgggcagg

SEQ ID NO: 514 - DNA, 26 bp, Artificial
  Primer
caggtcggtcttctggagatgaaagg

SEQ ID NO: 515 - DNA, 31 bp, Artificial
  Primer
cagatgagtgctggtaatatgtgagaaattg

SEQ ID NO: 516 - DNA, 25 bp, Artificial
  Primer
cctgtgactacatcgaccctgtcca

SEQ ID NO: 517 - DNA, 21 bp, Artificial
  Primer
gcctcgtcgtggaaacccatc

SEQ ID NO: 518 - DNA, 24 bp, Artificial
  Primer
cgttatcggcatcgagattcacca

SEQ ID NO: 519 - DNA, 30 bp, Artificial
  Primer
cgagacgtacataccatccaagaacttacg

SEQ ID NO: 520 - DNA, 27 bp, Artificial
  Primer
cgagtttgtcgatgacttcacagtacg

SEQ ID NO: 521 - DNA, 25 bp, Artificial
  Primer
caatgcttgaatcgagggtttgttg

SEQ ID NO: 522 - DNA, 21 bp, Artificial
  Primer
cgtccgttttggactgtggca

SEQ ID NO: 523 - DNA, 23 bp, Artificial
  Primer
gcacggtggatgtgctcaacaag

SEQ ID NO: 524 - DNA, 22 bp, Artificial
  Primer
ggtggtcctcgcagcttcaatc

SEQ ID NO: 525 - DNA, 27 bp, Artificial
  Primer
gaggaaggtcttgatctggctaatggt

SEQ ID NO: 526 - DNA, 500 bp, Magneporthe grisae
atggacaccctggtagcccgctacagccgcccggcttaccagcagaacgagacattcacagaagatgatcagcaagacctttgcgattccgtcccaagtctttcactcaagtttgcggttccgccagtagcacatccctcatcttggctccgcacagcaacggacgaccacgcaaacccaaactgccccatcaagatcgcacacggaacgacgacgctcgctttcaggtttcagggaggcatcatcgttgcgaccgactctcgtgccaccgccggcaactggattgcttcgcagacggtcaagaaggtcatcgagatcaactcttgcctgctcggcaccatggccggcggtgccgcagactgccagtactggctcgcctggctgggcatgcagtgccgtctgcacgagctccgccacaagcgccgcatctcggtcgccgccgcctccaagattctcgccaacctcgtctaccagtacaagggcatgggcctcagcatggg

SEQ ID NO: 527 - DNA, 400 bp, Magneporthe grisae
accaggccgacctgctcgtctcacatacacagttccccgagaatgctgcaaacaaccaagttgcgcggtatctctactaccttggtcggattcgcgccatacagctgcgctacacggaggcacacgagcacctgacggctgcgacgcggaaggcaccgagctctaactgcgcggttggtttctcgcagacggccaccaagcttttgctggtggttgagcttcttatgggcgatattcctgatcgcgcgaccttccgccaaccgaccctcgaggaggcactgcacccttacttcctgctagtccaggctgttcgggtcggtaacctcgacaacttcgagacgaccattgcggaccacgccgatactttccgcaaggacggaacctacaccctcatcctccg

SEQ ID NO: 528 - DNA, 400 bp, Magneporthe grisae
tccagtttgcggagtacatcatggcaaacgcgaagctctattcgatgcgtaacgagaccgatctttcaccgtccgcattggcgcattacgtccgtggcgagcttgcctcgagcttgaggtcgcggaagccatacacagtcaacctcctcttgggcggtgtcgaccccatcacacacaagccgagcctctactggctggactaccttgcggctctggcgccggtcccatatgctgcgcatggatatgctcagtactactgcctctccatcctcgacaaacatcaccatcccgatatcaccctgcaccagggtatcaagatcctgactatgtgcaccgacgagctgaagaggagattaccgattgacttcaaaggaatggtggtgaaggcggtgacaaagga

SEQ ID NO: 529 - DNA, 400 bp, Magneporthe grisae
atgggtatcgatcttaagaagcaccacgtgcgcagcacgcaccgcaaggcccccaagagcgacaatgtctacctcaagctcttggtgaagctctaccgcttcctggcccgcaggaccgactccagcttcaacaaggttgtccttcgccgcctctttatgtcgcgcaccaaccgccctcccgtctccctgtcgcgcatcgcaggcaacctgaagaacggcaacgagaagaagaccgttgtcgttgtcggcaccgtcaccgacgacaaccgcctggttgagtgccccaaggcccaggtcgctgcccttcgcttcaccgccaccgcccgtgcccgcatcgttgccgccggcggccaggccatcacccttgaccagctggctcttgagaagcccactggtgcca

SEQ ID NO: 530 - DNA, 400 bp, Magneporthe grisae
tgactccgagggccacgttggtctgggtatcaagacctccaaggaggttgccactgctatccgcgccgccatcattattgccaagcttagcgtcatccccgtccgtcgtggttactggggtaccaaccttggtactcctcactcgctccccgtcaaggagagcggcaagtgcggttccgtcactgtccgccttatccctgctccccgtggtaccgccctggttgcctcgcccgctgtcaagcgtctcctccagcttgctggtatcgaggatgcctacacatcgtcgtcaggctcaaccaagaccctcgagaacaccctgaaggccactttctcggccgtttccaacacatacggtttccttacccccaacctgtggaaggagaccaagctcatcaggagc

SEQ ID NO: 531 - DNA, 400 bp, Magneporthe grisae
atggcgaccaacggcgatgctgctcccccggcgccggcggcagagacggcagctgcgactgcggccgcggcacagctcgacggcctcaggcctcccgagggcgtcatcattccgccacccggtgagatccgcgaggtgattgaaaagacggccgggtacgtggcgcgtggtggactgggcatcgagcagcgcctacgcgagaaccacagcgggaacccaaagttcagcttcgtcacgagccagagcgacgcgtacaatccgtactacgagtggcgcaaggccgagtacaaggccgggcgtggcacggcgctggcggctggtcgggcggatgcggccgcgttggcggccgccaagctggcagagcagaacaaggagccccagggcccgcccaagccgccgg

SEQ ID NO: 532 - DNA, 400 bp, Magneporthe grisae
tcgccaagcccacgcagtcgtcagaaggcatgtacgattctcgacttttcaaccaatcatctggtttcgagggcggcatcaacgaggacaacccttatgacaagccgctttttgctgttcaggacgccatcagtagtatctaccggccccgtgcgaacaacgatgatgaggacgaggcggctggcgatgcggagatggccaagatacaaaaggcgagcagatatggtgaggtgctaggccgaggtacattctccggtgccggggatgtggaagcccgagaaggtccagtgcagttcgaaaaggatgctgcaggcgcggaccctttcaatgtggacaagttcctgtccgaggtcgaacagaccgcgtcatcaaagaggggttatggtctgcaagactcgag

SEQ ID NO: 533 - DNA, 400 bp, Magneporthe grisae
ctttcagcacgataccgcgagctcatgtcgacaccccgtgggttttagctcacatcggacgcgctcagtatgaacagaccaagtatgctgaagcagaggcctccttcaagcgcttaagaacattggcaccgaatcggctggaggacatggaggtctattccacagtactttggcacctgaagaaggaaacagaggcatcgtttctggcacacgagcttgttgacatagcgtggcattcaccgcacgcctggtgcgccttgggcaatgcatggtcgctggcatcagatcgcgaacaagcgctgcggtgcttcaagcgtgctacgcagctcgacgcaaaatttgcatatgcctacacacttcaagggcatgagcactttgttagtgaagaatacgataaggc

SEQ ID NO: 534 - DNA, 400 bp, Magneporthe grisae
acgctcttggtcgcatcaccgaggcctgctccgaggctattgaccccagccagcacctcgagcctctgatccgctcgttgtttgctggcctgctaaacactcccaagatggccgcctcgtgctgttgggctctgatgaacctggcggaacgttttgccggtgagcccggagcgccccagaatgccatcactgcctacttcaacgacagtgtgcgcagcctcctggacgtcaccgccaagaacgattgcgactcggctgtcaggacggccgcgtatgaggttctcaacgctttcatcgtcaatgcggcaaacgatagtctgcaggctgttgccactctttcggatgttatcatcaagcgcctagaggagacgataccactacagacccaggttgtcagcgt

SEQ ID NO: 535 - DNA, 400 bp, Magneporthe grisae
tgtcagggcctcggagtctgctggcggcccgcctcgcctcaacttggctggtgcaggtggcaagcccagctggcgtgacagggtcccatcttcaaacgtcggagccgctccctcggagcgttctgagcgtccctcggagcgccctgctcctgcccgaactggtacccccatggagcgcactgattcaaacgatcgtgctggtggtccgccccggcttaaccttgctcgtgctgacggtgccaagcccagctggcgtgaacgtgagcaggccaaggctagcggtggccctgagcgggatcttcctcccagcagggcggcttctggaaggggcccaccgatgcacaggaccgattcgggccgtggagagaacggcagggacgagtcgccggcgccccccaga

SEQ ID NO: 536 - DNA, 194 bp, Magneporthe grisae; identical to SEQ ID NO: 116

SEQ ID NO: 537 - DNA, 394 bp, Magneporthe grisae
ccgtggaaaggtttccatgaaggaggtcgaggaccagatgcgcaacgtccagaacaagaactcgtcgtacttcgtcgagtggatccccaacaacatccagaccgctctctgctctatcccgccccgcggcctcaagatgtcgtcgactttcatcggaaactcgaccgccatccaggagctgttcaagcgtgtcggtgagcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 538 - DNA, 600 bp, Magneporthe grisae
gatctccgcaagcttgccgtcaacatggttcccttccctcgtctgcacttcttcatggttggcttcgctcctttgaccagccgtggtgcccactctttccgcgctgtcaccgttcccgagttgacccagcagatgttcgaccccaagaacatgatggctgcttctgacttcaggaatggtcgttacctgacctgctctgccatcttccgtggaaaggtttccatgaaggaggtcgaggaccagatgcgcaacgtccagaacaagaactcgtcgtacttcgtcgagtggatccccaacaacatccagaccgctctctgctctatcccgccccgcggcctcaagatgtcgtcgactttcatcggaaactcgaccgccatccaggagctgttcaagcgtgtcggtgagcagttcactgccatgttcaggcgcaaggctttcttgcattggtacactggtgagggtatggacgagatggagttcactgaggccgagtccaacatgaacgatcttgtttccgagtaccagcagtaccaggatgctggtgttgacgaggaggaagaggagtacgaggaggaggcccctcttgagggcgaggagtag

SEQ ID NO: 539 - DNA, 400 bp, Magneporthe grisae
ctgttatgtctgccagcacaacgacactgcgatacccaggctacatgcacaatgacctcgtcagcatattggcgtccttgatccctacgcccaaatgccacttcttgatgacatcatatactccttttacgggagatcaagtcgagcaggcaaagacggtgcgcaagacgacagttttggatgtcatgcgcaggttactgcagcccaagaaccgcatggtttcaacgatacccgggaagaagagttgttacatttcaattctcaatgtgattcaaggcgaagttgatccaaccgatgttcacaagtctttgctgcgcattcgtgaaaggaggttggcaacttttattccttggggaccggcgagtatccaggttgctttgaccaaaaggagcccatacat

SEQ ID NO: 540 - DNA, 400 bp, Magneporthe grisae
gagtatccaggttgctttgaccaaaaggagcccatacataccaatgagccaccgtgtcagcggtctcatgttagccaaccacaccagcattgctacagtaaggaacacttttgttgtatttttgatcacagaattcatactgaccaagtgcgcccttaatgttctgcagcttttcaaaaggatcgtaaggcaatacgacgggatgcgcaagcgcaacgcattcatagaaggctacaagaagacacagccattctcggaaaaccttgatgagtttgacgaagcgcggcaagtggtcagcgaccttatcgcagagtacgaagctgccgaagatgccaactatttaaacccggatgccggtgagcctggcacctcggccgagacggatcggagaatggggtga

SEQ ID NO: 541 - DNA, 427 bp, Magneporthe grisae
gtctcaagaacaagcgtgaggtctggcgtgtccagctcactctgtccaagattcgtcgtgctgcccgtcagcttcttaccctcgacgagaaggaccccaagcgcctgttcgagggtaacgccttgattcgccgtctggtgcgtgtcggtgttcttgacgagtcgcgcatgaagctcgattacgttcttgccctcaaggtcgaggacttcctggagcgccgtctccagacctgcgtctacaagcttggtctcgccaagtccatccaccacgcccgtgtcctcattcgccagcgccacatccgcgtcggcaagcagatcgtcaacgtcccctcgttcgtcgtccgtctcgactcccagaagcacatcgacttcgcccttacctcgccatttggcggtggccgtcccggccgtgtccgcagaaagaaggc

SEQ ID NO: 542 - DNA, 403 bp, Magneporthe grisae
catcttggggctgcgatcacaactcgacatgcttcagaagcgtgaaaagcacctgcaaaatcagatttccgaacaggatgcgatcgcgaggaagaacatttcaacaaacaagaatgccgccaaggccgcgttgaagaggaagaagacacatgagcacagtcttgaccaaacgctctcgcagatcggcacccttgagcagcagataaacgctatcgagtctgcaaacatcaacatggaaaccctcgaggccatgaagaaggcaggcaaggccatggaggacatacacggaaagcttacggtagagaaggtcgatgagaccatggacaagttacgggagcagaatgctctcagcgaggagattgtcaacgccatcacaaacaatcagctcggaaacgaggcaatc

SEQ ID NO: 543 - DNA, 405 bp, Magneporthe grisae
gcaaggtccgcaccgactcgacttaccccgccggcttcatggacgttgtttcgatcgagaagactggcgagaacttccgtctcgtctacgacaccaagggacgcttcaccgtccaccgcatccaggccgaggaggccgagtacaagctcggcaaggtcaagcgtgttcagctcggccgcggcgggatcccattcttggttacgcatgatgccagaaccatccgctaccccgaccctctgatcaaggtcaacgacactgtcaagatcaaccttgacactggcaagatcaccgacttcatcaagttcgacactggcgccctcgccatggttaccgctggtaacaacatgggtcgtgttggtgttatcacccaccgtgagcgccacgatggtggcttcaacattgtgc

SEQ ID NO: 544 - DNA, 404 bp, Magneporthe grisae
cctcttgcgtgagcatggataccaatctcgaggctttgaggttctctatcacggccacactggtcggaagctgagagctcaagtcttctttggaccgacatactaccagcgtctgaggcacatggtggacgataagattcacgcccgagcacgtggtcccgtcaacatcatgacaagacagccagtggagggtcgtgcgcgtgatggtggtctgcgtttcggagaaatggaacgtgattgcatgattgcacacggagcagcctccttcttgaaggagaggttgtttgaggtttcggatgcgttcagggcgcatatctgtggtatttgtgggctgatgacgcccattgccgatctcaccaggaaaacattcgagtgtcggccatgtaggaacaagaccaagatcg

SEQ ID NO: 545 - DNA, 400 bp, Magneporthe grisae
ggagcaggtccagtacccagtcgaccaccccgagaagttcctcaagttcggtctctcaccatcgcgtggcgtgcttttctacggtcccccgggtaccggaaagaccatgttggccaaggccgttgccaacgagtgtgcagcaaactttatctccgtcaagggtccagagctgctcagcatgtggtttggagagtcggaaagcaacattcgtgatatcttcgacaaagcgcgcgctgcggcaccttgcattgttttccttgacgagcttgactcaatcgccaaggctcgtggaggctcggtgggtgacgccggcggtgcatcggaccgtgttgtaaaccagctgctgacggagatggacggtatgacttccaagaagaacgtgttcgttattggagcgacc

SEQ ID NO: 546 - DNA, 399 bp, Magneporthe grisae
gccagtgcggtatcatcatgtttgacgtcacatcccgcatcacctacaagaacgtccccaactggcaccgtgacttggttcgtgtgtgcgagaacatccctattgttctctgcggtaacaaggtcgacgtcaaggagcgcaaggtgaaggccaagaccatcaccttccacaggaagaagaacctgcagtattacgacatctcggccaagtcgaactacaacttcgagaagcctttcctgtggctcggccgcaagcttgttggcaaccccggtctggaattcgttgccgcccccgcccttgctccccccaccgccgaggtgaccgcagagcaggcggccgcgtacgagaaagaccttgcagatgctacgcgtgcgcccctgcccgatgatgatgatgaag

SEQ ID NO: 547 - DNA, 409 bp, Magneporthe grisae
caggtcggtcttctggagatgaaaggtctcagcaactccacaggtggtcatatgattttggtcgatagctttacgtcgtccatgttcaagcagtcgttcgtgagggtattcgaaaaggatggagacgacaacctgctcatgggtttcaacggtatcttggaggtcctgaccaccaaggagctcaaggttacaggtctgattggtcacgccgtctcgatgaacaagaagtcgacctctgtcggtgagaccgagtgcggtattggcaacacgtgctcgtggaagatgtgcggtattgacccaacatcaagctacggcatctacttcgaggttgcacaaggtggcccgtcacacgcccaaccagctcagaaagggatgatgcaatttctcacatattaccagcactcatctg

SEQ ID NO: 548 - DNA, 395 bp, Magneporthe grisae
cctgtgactacatcgaccctgtccattgtccaggtcttctggggtctcgacaagaaactggcacagcgcaagcacttcccgtccatcaacacttccctttcgtacagcaagtacacgatgatattggagaagtggtacgagaaggagcaccccgacttcccacgtctgcgtgaccaggtcaggcagctgctgtcagactcggaggagctggaccaggtcgtgcagcttgtcggcaagtcggcgctttcggaccccgacaagatcacacttgacatggccacgctgctcaaggaggactttttgcagcagaacggctacagtgactacgaccagttctgtcccatctggaagacagagtggatgatgcgcctgatgatgggtttccacgacgaggc

SEQ ID NO: 549 - DNA, 400 bp, Magneporthe grisae
cgttatcggcatcgagattcaccacggcaagcgcaaggatgtcgccaccctccgtaccgtccgcaccctgatcaacaacttgatcattggtgtcaccaagggctacaagtacaagatgcgttacgtctacgcccatttccccatcaacgtcaacgttgagaagaacaacgagactggcaacgccgaggtcgagatccgaaacttcatcggcgagaagctcgtccgcagggtcgccatgcagcctggtgttgaggttgagatctcaaaggcccagaaggatgagctcatcctgtccggtaactctgtcgaggctgtctcgcaaagcgccgccgatatccagcagatctgcaaagtacggaacaaggatatccgtaagttcttggatggtatgtacgtctcg

SEQ ID NO: 550 - DNA, 400 bp, Magneporthe grisae
cgagtttgtcgatgacttcacagtacgcgtcgttgatgtttttgccatgccacaaagcggtactggagtcagtgtcgaggcagtcgacccggtgttccagatgaagatgatggatatgttgcggcaaacaggaaggcccgagtccgtcgtgggctggtaccactcacatcccggtttcggctgctggttgtcgtcggtggatatcaacactcagcagagtttcgagcagctcacaccacgtgccgtcgctgtggtcgttgacccgattcagtccgtcaaaggaaaggttgtcatagacgctttccgtctcatcaacccgcaatctctcatgctcggacaggagccccgccaaagcacatccaaccttggccacctcaacaaaccctcgattcaagcattg

SEQ ID NO: 551 - DNA, 400 bp, Magneporthe grisae
cgtccgttttggactgtggcaagaacaagatctggctggaccccaacgaggtgtccgagatctccaacgccaactcccgccagaccatccgcaagcttgtccaggatggcctgatcatcaagaagccagtcaccatgcactcaagagcacgcgctcgggagcttaacctcgcccgacggatcggccggcaccgtggtttcggaaagcgcaagggtaccgcagatgcccgtatgccgactcaggtcgtctggatgcgccgccagcgggttctccgtcggttgctcgtcaagtaccgcgccagcggcaagatcgacaagcacctttaccacgagctttaccactccgccaagggtaacaccttcaagcacaagcgtgcgcttgttgagcacatccaccgtgc

SEQ ID NO: 552 - DNA, 400 bp, Magneporthe grisae
ggtggtcctcgcagcttcaatctgcactcgcggcggcaaggctgtcctgtcgaggcagttccgcgagatgccccggtcgaggatagaagctttgctcgcctcgttcccaaagcttgccgacagtggtacccagcacacgaccgttgagcaggacaatgttcgattcgtctaccagcccctcgacgagctctacatggttctcatcacgaaccgtcagtccaacatccttcaggatatcgactccctgcaccttttcgcacaggttgtgaccagcacttgcaagagcttggacgagcgggagattctcaagaatgcctacgaactccttagcgcctttgacgagctggttactctgggctacagggagaacttgaccattagccagatcaagaccttcctc

SEQ ID NO: 553 - DNA, 400 bp, Artificial
  Seastar AFP sequence (nt 51-450)
tgtaaacgggcatgcttttgtgattgaaggaaaaggagaaggaaagcctttcgatgggacacacactttaaacctggaagtgaaagaaggtgcacctctgcctttttcctacgatatcttgtcaaacgcgttcgcgtacggaaacagagcattgaccaaatacccagacgatatagcagactatttcaagcagtcgtttcccgagggatattcctgggaaagaagcatgacttttgaagacaaaggcattgtcaccgtggaaactgacgtcagcatggaagacgactgctttatctataaaattcgttttgatggggtgaactttcctcccaatggtccagtaatgcagaagaaaactttgaggtgggaaccatccactgagattatgtacgttcgtgat

SEQ ID NO: 554 - DNA, 400 bp, Artificial
  GST sequence (nt 241-640)
atgtcccctatactaggttattggaaaattaagggccttgtgcaacccactcgacttcttttggaatatcttgaagaaaaatatgaagagcatttgtatgagcgcgatgaaggtgataaatggcgaaacaaaaagtttgaattgggtttggagtttcccaatcttccttattatattgatggtgatgttaaattaacacagtctatggccatcatacgttatatagctgacaagcacaacatgttgggtggttgtccaaaagagcgtgcagagatttcaatgcttgaaggagcggttttggatattagatacggtgtttcgagaattgcatatagtaaagactttgaaactctcaaagttgattttcttagcaagctacctgaaatgctgaaaatgttcg

SEQ ID NO: 555 - DNA, 400 bp, Artificial (nt 1-400)
  GFP sequence
atgactttttcaagagtgccatgcccgaaggttatgtacaggaaagaactatatttttcaaagatgacgggaactacaagacacgtgctgaagtcaagtttgaaggtgatacccttgttaatagaatcgagttaaaaggtattgattttaaagaagatggaaacattcttggacacaaattggaatacaactataactcacacaatgtatacatcatggcagacaaacaaaagaatggaatcaaagttaacttcaaaattagacacaacattgaagatggaagcgttcaactagcagaccattatcaacaaaatactccaattggcgatggccctgtccttttaccagacaaccattacctgtccacacaatctgccctttcgaaagatcccaacgaaaa

SEQ ID NO: 556 - DNA, 798 bp, Magnaporthe grisae
atggccgacgcagcaccccgtggcggcggtttcgcatcgcgtggaggagaccgtggcggcgaccgcggccgtggtgaccgtggccgtggacgtggacgtggccgtggccgtcgtggcggcaagtccgacgagaaggagtggcagcccgttaccaagctcggccgtctcgtgaaggccggcaagatcaagagcatggaggagatctacttgcactcgctccccatcaaggagtaccagatcgtcgactttttcctgcccaagctcaaggacgaggtcatgaagatcaagcccgtccagaagcagacccgtgccggtcagcgtacccgtttcaaggccatcgtcatcattggtgactccgagggccacgttggtctgggtatcaagacctccaaggaggttgccactgctatccgcgccgccatcattattgccaagcttagcgtcatccccgtccgtcgtggttactggggtaccaaccttggtactcctcactcgctccccgtcaaggagagcggcaagtgcggttccgtcactgtccgccttatccctgctccccgtggtaccgccctggttgcctcgcccgctgtcaagcgtctcctccagcttgctggtatcgaggatgcctacacatcgtcgtcaggctcaaccaagaccctcgagaacaccctgaaggccactttctcggccgtttccaacacatacggtttccttacccccaacctgtggaaggagaccaagctcatcaggagcccgctggaggagtttgccgacaccctcagggacggcaagcgttactag

SEQ ID NO: 557 - DNA, 24 bp, Artificial
  Primer
atgcgtgaaattgttcaccttcag

SEQ ID NO: 558 - DNA, 24 bp, Artificial
  Primer
ctactcctcgccctcaagaggggc

SEQ ID NO: 559 - DNA, 24 bp, Artificial
  Primer
gtctctactgttatgtctgccagc

SEQ ID NO: 560 - DNA, 24 bp, Artificial
  Primer
tcaccccattctccgatccgtctc

SEQ ID NO: 561 - DNA, 768 bp, Magnaporthe grisae
gtctctactgttatgtctgccagcacaacgacactgcgatacccaggctacatgcacaatgacctcgtcagcatattggcgtccttgatccctacgcccaaatgccacttcttgatgacatcatatactccttttacgggagatcaagtcgagcaggcaaagacggtgcgcaagacgacagttttggatgtcatgcgcaggttactgcagcccaagaaccgcatggtttcaacgatacccgggaagaagagttgttacatttcaattctcaatgtgattcaaggcgaagttgatccaaccgatgttcacaagtctttgctgcgcattcgtgaaaggaggttggcaacttttattccttggggaccggcgagtatccaggttgctttgaccaaaaggagcccatacataccaatgagccaccgtgtcagcggtctcatgttagccaaccacaccagcattgctacagtaaggaacacttttgttgtatttttgatcacagaattcatactgaccaagtgcgcccttaatgttctgcagcttttcaaaaggatcgtaaggcaatacgacgggatgcgcaagcgcaacgcattcatagaaggctacaagaagacacagccattctcggaaaaccttgatgagtttgacgaagcgcggcaagtggtcagcgaccttatcgcagagtacgaagctgccgaagatgccaactatttaaacccggatgccggtgagcctggcacctcggccgagacggatcggagaatggggtga

SEQ ID NO: 562 - DNA, 29 bp, Magneporthe grisae
gcagactgccagtactggctcgcctggct

SEQ ID NO: 563 - DNA, 25 bp, Magneporthe grisae
tacaagggcatgggcctcagcatgg

SEQ ID NO: 564 - DNA, 21 bp, Magneporthe grisae
cttttttttttttttttgctg

SEQ ID NO: 565 - DNA, 21 bp, Magneporthe grisae
gagactttttttttttttttt

SEQ ID NO: 566 - DNA, 21 bp, Magneporthe grisae
gctctgaatcgtcgtccgagc

SEQ ID NO: 567 - DNA, 26 bp, Magneporthe grisae
tactactgcctctccatcctcgacaa

SEQ ID NO: 568 - DNA, 21 bp, Magneporthe grisae
tgaagaggagattaccgattg

SEQ ID NO: 569 - DNA, 23 bp, Magneporthe grisae
ttttttttttttttttgctgcgg

SEQ ID NO: 570 - DNA, 29 bp, Magneporthe grisae
accgactccagcttcaacaaggttgtcct

SEQ ID NO: 571 - DNA, 56 bp, Magneporthe grisae
agagcgacaatgtctacctcaagctcttggtgaagctctaccgcttcctggcccgc

SEQ ID NO: 572 - DNA, 24 bp, Magneporthe grisae
caaccgccctcccgtctccctgtc

SEQ ID NO: 573 - DNA, 22 bp, Magneporthe grisae
cggcaccgtcaccgacgacaac

SEQ ID NO: 574 - DNA, 59 bp, Magneporthe grisae
gcccccaagagcgacaatgtctacctcaagctcttggtgaagctctaccgcttcctggc

SEQ ID NO: 575 - DNA, 27 bp, Magneporthe grisae
ttcaccgccaccgcccgtgcccgcatc

SEQ ID NO: 576 - DNA, 32 bp, Magneporthe grisae
accaagaccctcgagaacaccctgaaggccac

SEQ ID NO: 577 - DNA, 45 bp, Magneporthe grisae
agcgtcatccccgtccgtcgtggttactggggtaccaaccttggt

SEQ ID NO: 578 - DNA, 30 bp, Magneporthe grisae
cccaacctgtggaaggagaccaagctcatc

SEQ ID NO: 579 - DNA, 29 bp, Magneporthe grisae
cccgctgtcaagcgtctcctccagcttgc

SEQ ID NO: 580 - DNA, 29 bp, Magneporthe grisae
ggtatcaagacctccaaggaggttgccac

SEQ ID NO: 581 - DNA, 44 bp, Magneporthe grisae
ttccttacccccaacctgtggaaggagaccaagctcatcaggag

SEQ ID NO: 582 - DNA, 48 bp, Magneporthe grisae
cagaacaagaactcgtcgtacttcgtcgagtggatccccaacaacatc

SEQ ID NO: 583 - DNA, 83 bp, Magneporthe grisae
cagttcactgccatgttcaggcgcaaggctttcttgcattggtacactggtgagggtatggacgagatggagttcactgaggc

SEQ ID NO: 584 - DNA, 31 bp, Magneporthe grisae
ccatccaggagctgttcaagcgtgtcggtga

SEQ ID NO: 585 - DNA, 29 bp, Magneporthe grisae
cccaacaacatccagaccgctctctgctc

SEQ ID NO: 586 - DNA, 52 bp, Magneporthe grisae
ccgttcccgagttgacccagcagatgttcgaccccaagaacatgatggctgc

SEQ ID NO: 587 - DNA, 44 bp, Magneporthe grisae
gagatggagttcactgaggccgagtccaacatgaacgatcttgt

SEQ ID NO: 588 - DNA, 27 bp, Magneporthe grisae
gaggaggaagaggagtacgaggaggag

SEQ ID NO: 589 - DNA, 36 bp, Magneporthe grisae
gagggtatggacgagatggagttcactgaggccgag

SEQ ID NO: 590 - DNA, 23 bp, Magneporthe grisae
gagtaccagcagtaccaggatgc

SEQ ID NO: 591 - DNA, 47 bp, Magneporthe grisae
gagttgacccagcagatgttcgaccccaagaacatgatggctgcttc

SEQ ID NO: 592 - DNA, 44 bp, Magneporthe grisae
gccgtcaacatggttcccttccctcgtctgcacttcttcatggt

SEQ ID NO: 593 - DNA, 35 bp, Magneporthe grisae
ggtcgttacctgacctgctctgccatcttccgtgg

SEQ ID NO: 594 - DNA, 24 bp, Magneporthe grisae
ggtgagcagttcactgccatgttc

SEQ ID NO: 595 - DNA, 44 bp, Magneporthe grisae
gtcaacatggttcccttccctcgtctgcacttcttcatggttgg

SEQ ID NO: 596 - DNA, 24 bp, Magneporthe grisae
taccagcagtaccaggatgctggt

SEQ ID NO: 597 - DNA, 38 bp, Magneporthe grisae
tacttcgtcgagtggatccccaacaacatccagaccgc

SEQ ID NO: 598 - DNA, 53 bp, Magneporthe grisae
tccatgaaggaggtcgaggaccagatgcgcaacgtccagaacaagaactcgtc

SEQ ID NO: 599 - DNA, 23 bp, Magneporthe grisae
tccgagtaccagcagtaccagga

SEQ ID NO: 600 - DNA, 32 bp, Magneporthe grisae
aacaagcgtgaggtctggcgtgtccagctcac

SEQ ID NO: 601 - DNA, 29 bp, Magneporthe grisae
aagtccatccaccacgcccgtgtcctcat

SEQ ID NO: 602 - DNA, 22 bp, Magneporthe grisae
caagcttggtctcgccaagtcc

SEQ ID NO: 603 - DNA, 35 bp, Magneporthe grisae
cagaagcacatcgacttcgcccttacctcgccatt

SEQ ID NO: 604 - DNA, 23 bp, Magneporthe grisae
cagacctgcgtctacaagcttgg

SEQ ID NO: 605 - DNA, 21 bp, Magneporthe grisae
cgcatgaagctcgattacgtt

SEQ ID NO: 606 - DNA, 41 bp, Magneporthe grisae
cgccagcgccacatccgcgtcggcaagcagatcgtcaacgt

SEQ ID NO: 607 - DNA, 50 bp, Magneporthe grisae
cgtcgtgctgcccgtcagcttcttaccctcgacgagaaggaccccaagcg

SEQ ID NO: 608 - DNA, 41 bp, Magneporthe grisae
ctcattcgccagcgccacatccgcgtcggcaagcagatcgt

SEQ ID NO: 609 - DNA, 29 bp, Magneporthe grisae
ctcgccaagtccatccaccacgcccgtgt

SEQ ID NO: 610 - DNA, 23 bp, Magneporthe grisae
gacgagaaggaccccaagcgcct

SEQ ID NO: 611 - DNA, 29 bp, Magneporthe grisae
gactcccagaagcacatcgacttcgccct

SEQ ID NO: 612 - DNA, 36 bp, Magneporthe grisae
gagaaggaccccaagcgcctgttcgagggtaacgcc

SEQ ID NO: 613 - DNA, 29 bp, Magneporthe grisae
gccaagtccatccaccacgcccgtgtcct

SEQ ID NO: 614 - DNA, 37 bp, Magneporthe grisae
ggcggtggccgtcccggccgtgtccgcagaaagaagg

SEQ ID NO: 615 - DNA, 29 bp, Magneporthe grisae
gtcggcaagcagatcgtcaacgtcccctc

SEQ ID NO: 616 - DNA, 29 bp, Magneporthe grisae
tccaagattcgtcgtgctgcccgtcagct

SEQ ID NO: 617 - DNA, 37 bp, Magneporthe grisae
tcgtccgtctcgactcccagaagcacatcgacttcgc

SEQ ID NO: 618 - DNA, 26 bp, Magneporthe grisae
aacatgggtcgtgttggtgttatcac

SEQ ID NO: 619 - DNA, 29 bp, Magneporthe grisae
aacttccgtctcgtctacgacaccaaggg

SEQ ID NO: 620 - DNA, 26 bp, Magneporthe grisae
acccaccgtgagcgccacgatggtgg

SEQ ID NO: 621 - DNA, 24 bp, Magneporthe grisae
agaaccatccgctaccccgaccct

SEQ ID NO: 622 - DNA, 23 bp, Magneporthe grisae
atcccattcttggttacgcatga

SEQ ID NO: 623 - DNA, 30 bp, Magneporthe grisae
atcgagaagactggcgagaacttccgtctc

SEQ ID NO: 624 - DNA, 23 bp, Magneporthe grisae
atggaacgtgattgcatgattgc

SEQ ID NO: 625 - DNA, 21 bp, Magneporthe grisae
caacatgggtcgtgttggtgt

SEQ ID NO: 626 - DNA, 36 bp, Magneporthe grisae
cactggcaagatcaccgacttcatcaagttcgacac

SEQ ID NO: 627 - DNA, 21 bp, Magneporthe grisae
ccccgccggcttcatggacgt

SEQ ID NO: 628 - DNA, 21 bp, Magneporthe grisae
cgaggaggccgagtacaagct

SEQ ID NO: 629 - DNA, 26 bp, Magneporthe grisae
cgccacgatggtggcttcaacattgt

SEQ ID NO: 630 - DNA, 26 bp, Magneporthe grisae
cgcttcaccgtccaccgcatccaggc

SEQ ID NO: 631 - DNA, 23 bp, Magneporthe grisae
gacttcatcaagttcgacactgg

SEQ ID NO: 632 - DNA, 21 bp, Magneporthe grisae
gagaaatggaacgtgattgca

SEQ ID NO: 633 - DNA, 35 bp, Magneporthe grisae
gagaagactggcgagaacttccgtctcgtctacga

SEQ ID NO: 634 - DNA, 21 bp, Magneporthe grisae
gaggaggccgagtacaagctc

SEQ ID NO: 635 - DNA, 38 bp, Magneporthe grisae
gaggaggccgagtacaagctcggcaaggtcaagcgtgt

SEQ ID NO: 636 - DNA, 26 bp, Magneporthe grisae
gcaaggtcaagcgtgttcagctcggc

SEQ ID NO: 637 - DNA, 22 bp, Magneporthe grisae
gcaaggtccgcaccgactcgac

SEQ ID NO: 638 - DNA, 26 bp, Magneporthe grisae
ggcgggatcccattcttggttacgca

SEQ ID NO: 639 - DNA, 41 bp, Magneporthe grisae
taccccgaccctctgatcaaggtcaacgacactgtcaagat

SEQ ID NO: 640 - DNA, 23 bp, Magneporthe grisae
ttcggagaaatggaacgtgattg

SEQ ID NO: 641 - DNA, 24 bp, Magneporthe grisae
agcaaactttatctccgtcaaggg

SEQ ID NO: 642 - DNA, 26 bp, Magneporthe grisae
agcaacattcgtgatatcttcgacaa

SEQ ID NO: 643 - DNA, 32 bp, Magneporthe grisae
atgttggccaaggccgttgccaacgagtgtgc

SEQ ID NO: 644 - DNA, 23 bp, Magneporthe grisae
ctcagcatgtggtttggagagtc

SEQ ID NO: 645 - DNA, 23 bp, Magneporthe grisae
gagaagttcctcaagttcggtct

SEQ ID NO: 646 - DNA, 32 bp, Magneporthe grisae
gagatggacggtatgacttccaagaagaacgt

SEQ ID NO: 647 - DNA, 22 bp, Magneporthe grisae
gtcgaccaccccgagaagttcc

SEQ ID NO: 648 - DNA, 23 bp, Magneporthe grisae
aacaaggtcgacgtcaaggagcg

SEQ ID NO: 649 - DNA, 34 bp, Magneporthe grisae
aactacaacttcgagaagcctttcctgtggctcg

SEQ ID NO: 650 - DNA, 26 bp, Magneporthe grisae
aagtcgaactacaacttcgagaagcc

SEQ ID NO: 651 - DNA, 32 bp, Magneporthe grisae
acctacaagaacgtccccaactggcaccgtga

SEQ ID NO: 652 - DNA, 35 bp, Magneporthe grisae
atcacctacaagaacgtccccaactggcaccgtga

SEQ ID NO: 653 - DNA, 35 bp, Magneporthe grisae; identical to SEQ ID NO: 652

SEQ ID NO: 654 - DNA, 26 bp, Magneporthe grisae
attgttctctgcggtaacaaggtcga

SEQ ID NO: 655 - DNA, 22 bp, Magneporthe grisae
gccagtgcggtatcatcatgtt

SEQ ID NO: 656 - DNA, 30 bp, Magneporthe grisae
tacaagaacgtccccaactggcaccgtgac

SEQ ID NO: 657 - DNA, 24 bp, Magneporthe grisae
atctggaagacagagtggatgatg

SEQ ID NO: 658 - DNA, 23 bp, Magneporthe grisae
cacttcccgtccatcaacacttc

SEQ ID NO: 659 - DNA, 21 bp, Magneporthe grisae
cagcgcaagcacttcccgtcc

SEQ ID NO: 660 - DNA, 26 bp, Magneporthe grisae
caggtcttctggggtctcgacaagaa

SEQ ID NO: 661 - DNA, 21 bp, Magneporthe grisae
ttctggggtctcgacaagaaa

SEQ ID NO: 662 - DNA, 32 bp, Magneporthe grisae
aacaaggatatccgtaagttcttggatggtat

SEQ ID NO: 663 - DNA, 27 bp, Magneporthe grisae
agcgccgccgatatccagcagatctgc

SEQ ID NO: 664 - DNA, 49 bp, Magneporthe grisae
caagtacaagatgcgttacgtctacgcccatttccccatcaacgtcaac

SEQ ID NO: 665 - DNA, 23 bp, Magneporthe grisae
cccagaaggatgagctcatcctg

SEQ ID NO: 666 - DNA, 32 bp, Magneporthe grisae
gagatccgaaacttcatcggcgagaagctcgt

SEQ ID NO: 667 - DNA, 35 bp, Magneporthe grisae
tacgtctacgcccatttccccatcaacgtcaacgt

SEQ ID NO: 668 - DNA, 24 bp, Magneporthe grisae
tgatcattggtgtcaccaagggct

SEQ ID NO: 669 - DNA, 23 bp, Magneporthe grisae
tttgccatgccacaaagcggtac

SEQ ID NO: 670 - DNA, 27 bp, Magneporthe grisae
tgcaagagcttggacgagcgggagatt

SEQ ID NO: 671 - DNA, 26 bp, Magneporthe grisae
aggaaggccaagcagctggagatgca

SEQ ID NO: 672 - DNA, 29 bp, Magneporthe grisae
ctcgacgagctctacatggttctcatcac

SEQ ID NO: 673 - DNA, 23 bp, Magneporthe grisae
caggatatcgactccctgcacct

SEQ ID NO: 674 - DNA, 23 bp, Magneporthe grisae
tacgaggctgagaagaacaagtc

SEQ ID NO: 675 - DNA, 23 bp, Magneporthe grisae
atcgccaacacatcgaacatgcc

SEQ ID NO: 676 - DNA, 21 bp, Magneporthe grisae
atcatgaagcgtaccaccctt

SEQ ID NO: 677 - DNA, 24 bp, Magneporthe grisae
atctggaagacagagtggatgatg

SEQ ID NO: 678 - DNA, 26 bp, Magneporthe grisae
caggtcttctggggtctcgacaagaa

SEQ ID NO: 679 - DNA, 26 bp, Magneporthe grisae
gagcgaggcaatgagatggctgaagt

SEQ ID NO: 680 - DNA, 21 bp, Magneporthe grisae
tggaagacagagtggatgatg

SEQ ID NO: 681 - DNA, 23 bp, Magneporthe grisae
atgcctgctgatcagggtttccc

SEQ ID NO: 682 - DNA, 23 bp, Magneporthe grisae
gaccaggtcgtgcagcttgtcgg

SEQ ID NO: 683 - DNA, 23 bp, Magneporthe grisae
cacttcccgtccatcaacacttc

SEQ ID NO: 684 - DNA, 21 bp, Magneporthe grisae
cagcgcaagcacttcccgtcc

SEQ ID NO: 685 - DNA, 21 bp, Magneporthe grisae
cagcgcaagcacttcccgtcc

SEQ ID NO: 686 - DNA, 32 bp, Magneporthe grisae
gccgagtacttccgtgaccagggcatgaacgt

SEQ ID NO: 687 - DNA, 21 bp, Magneporthe grisae
ttctggggtctcgacaagaaa

SEQ ID NO: 688 - DNA, 41 bp, Magneporthe grisae
agcattgtcggtgccgtcagcccgcccggtggtgatttctc

SEQ ID NO: 689 - DNA, 26 bp, Magneporthe grisae
atcgagaagactggcgagaacttccg

SEQ ID NO: 690 - DNA, 21 bp, Magneporthe grisae
cctcgcccggtcctcacaagc

SEQ ID NO: 691 - DNA, 35 bp, Magneporthe grisae
gtcaaggttgacggcaaggtccgcaccgactcgac

SEQ ID NO: 692 - DNA, 21 bp, Magneporthe grisae
aacatgggtcgtgttggtgtt

SEQ ID NO: 693 - DNA, 24 bp, Magneporthe grisae
agaaccatccgctaccccgaccct

SEQ ID NO: 694 - DNA, 23 bp, Magneporthe grisae
ccatcgctgaggagcgtgaccgc

SEQ ID NO: 695 - DNA, 26 bp, Magneporthe grisae
gcaaggtcaagcgtgttcagctcggc

SEQ ID NO: 696 - DNA, 26 bp, Magneporthe grisae
ggcgggatcccattcttggttacgca

SEQ ID NO: 697 - DNA, 21 bp, Magneporthe grisae
aacatgggtcgtgttggtgtt

SEQ ID NO: 698 - DNA, 21 bp, Magneporthe grisae
actggcaagatcaccgacttc

SEQ ID NO: 699 - DNA, 30 bp, Magneporthe grisae; identical to SEQ ID NO: 623

SEQ ID NO: 700 - DNA, 24 bp, Magneporthe grisae
cccaagggcaagggtgtcaagctc

SEQ ID NO: 701 - DNA, 26 bp, Magneporthe grisae
ggcgggatcccattcttggttacgca

SEQ ID NO: 702 - DNA, 42 bp, Magneporthe grisae
aagccctggatctccctgcccaagggcaagggtgtcaagctc

SEQ ID NO: 703 - DNA, 26 bp, Magneporthe grisae
acccaccgtgagcgccacgatggtgg

SEQ ID NO: 704 - DNA, 23 bp, Magneporthe grisae
ccatcgctgaggagcgtgaccgc

SEQ ID NO: 705 - DNA, 26 bp, Magneporthe grisae
cgcttcaccgtccaccgcatccaggc

SEQ ID NO: 706 - DNA, 21 bp, Magneporthe grisae
gacggcaaggtccgcaccgac

SEQ ID NO: 707 - DNA, 21 bp, Magneporthe grisae
gaggaggccgagtacaagctc

SEQ ID NO: 708 - DNA, 26 bp, Magneporthe grisae
gcaaggtcaagcgtgttcagctcggc

SEQ ID NO: 709 - DNA, 26 bp, Magneporthe grisae
gcaaggtcaagcgtgttcagctcggc

SEQ ID NO: 710 - DNA, 22 bp, Magneporthe grisae
taagaagcaccagaagcgcctt

SEQ ID NO: 711 - DNA, 32 bp, Magneporthe grisae
aagatcaccgacttcatcaagttcgacactgg

SEQ ID NO: 712 - DNA, 26 bp, Magneporthe grisae
cgtgagagcaacgttttcgtcatcgg

SEQ ID NO: 713 - DNA, 24 bp, Magneporthe grisae
atcaaggtcaacgacactgtcaag

SEQ ID NO: 714 - DNA, 51 bp, Magneporthe grisae
ctgcccaagggcaagggtgtcaagctcaccatcgctgaggagcgtgaccgc

SEQ ID NO: 715 - DNA, 26 bp, Magneporthe grisae
aacatgggtcgtgttggtgttatcac

SEQ ID NO: 716 - DNA, 23 bp, Magneporthe grisae
ccatcgctgaggagcgtgaccgc

SEQ ID NO: 717 - DNA, 27 bp, Magneporthe grisae
cgtgagagcaacgttttcgtcatcggc

SEQ ID NO: 718 - DNA, 27 bp, Magneporthe grisae
cgtgagagcaacgttttcgtcatcggc

SEQ ID NO: 719 - DNA, 27 bp, Magneporthe grisae
cgtgagagcaacgttttcgtcatcggc

SEQ ID NO: 720 - DNA, 34 bp, Magneporthe grisae
ctgcccaagggcaagggtgtcaagctcaccatcg

SEQ ID NO: 721 - DNA, 46 bp, Magneporthe grisae
ctgcccaagggcaagggtgtcaagctcaccatcgctgaggagcgtg

SEQ ID NO: 722 - DNA, 24 bp, Magneporthe grisae
gggtgtcaagctcaccatcgctga

SEQ ID NO: 723 - DNA, 26 bp, Magneporthe grisae
tgcccaagggcaagggtgtcaagctc

SEQ ID NO: 724 - DNA, 22 bp, Magneporthe grisae
acaacatgggtcgtgttggtgt

SEQ ID NO: 725 - DNA, 21 bp, Magneporthe grisae
caaggccatcctgatgcagcg

SEQ ID NO: 726 - DNA, 21 bp, Magneporthe grisae
cgaggaggccgagtacaagct

SEQ ID NO: 727 - DNA, 23 bp, Magneporthe grisae
atcccattcttggttacgcatga

SEQ ID NO: 728 - DNA, 21 bp, Magneporthe grisae
cgaggaggccgagtacaagct

SEQ ID NO: 729 - DNA, 29 bp, Magneporthe grisae
aacttccgtctcgtctacgacaccaaggg

SEQ ID NO: 730 - DNA, 26 bp, Magneporthe grisae
cgccacgatggtggcttcaacattgt

SEQ ID NO: 731 - DNA, 21 bp, Magneporthe grisae
ccccgccggcttcatggacgt

SEQ ID NO: 732 - DNA, 21 bp, Magneporthe grisae
ccccgccggcttcatggacgt

SEQ ID NO: 733 - DNA, 29 bp, Magneporthe grisae
aagatcaccgacttcatcaagttcgacac

SEQ ID NO: 734 - DNA, 26 bp, Magneporthe grisae
cgtgagagcaacgttttcgtcatcgg

SEQ ID NO: 735 - DNA, 23 bp, Magneporthe grisae
ctcatcgtcttcatccgcaaccg

SEQ ID NO: 736 - DNA, 21 bp, Magneporthe grisae
atcaaggtcaacgacactgtc

SEQ ID NO: 737 - DNA, 26 bp, Magneporthe grisae
gaccctctgatcaaggtcaacgacac

SEQ ID NO: 738 - DNA, 38 bp, Magneporthe grisae; identical to SEQ ID NO: 635

SEQ ID NO: 739 - DNA, 32 bp, Magneporthe grisae
ggcaagatcaccgacttcatcaagttcgacac

SEQ ID NO: 740 - DNA, 30 bp, Magneporthe grisae
gtcaaggttgacggcaaggtccgcaccgac

SEQ ID NO: 741 - DNA, 22 bp, Magneporthe grisae
cctcgcggtgccatgatcttct

SEQ ID NO: 742 - DNA, 26 bp, Magneporthe grisae
aacaagtattccgagggttaccccgg

SEQ ID NO: 743 - DNA, 21 bp, Magneporthe grisae
cgcggtgccatgatcttcttc

SEQ ID NO: 744 - DNA, 23 bp, Magneporthe grisae
tccgtcttccccggtcaccaggg

SEQ ID NO: 745 - DNA, 26 bp, Magneporthe grisae
tccgtcttccccggtcaccagggcgg

SEQ ID NO: 746 - DNA, 24 bp, Magneporthe grisae
tacgaccttgagaaccccatcaac

SEQ ID NO: 747 - DNA, 32 bp, Magneporthe grisae
cgtcatccccgtccgtcgtggttactggggta

SEQ ID NO: 748 - DNA, 32 bp, Magneporthe grisae
aactcgaccgccatccaggagctgttcaagcg

SEQ ID NO: 749 - DNA, 21 bp, Magneporthe grisae
atccaggagctgttcaagcgt

SEQ ID NO: 750 - DNA, 21 bp, Magneporthe grisae
caacatgaacgatcttgtttc

SEQ ID NO: 751 - DNA, 26 bp, Magneporthe grisae
cagaacaagaactcgtcgtacttcgt

SEQ ID NO: 752 - DNA, 39 bp, Magneporthe grisae
cattggtacactggtgagggtatggacgagatggagttc

SEQ ID NO: 753 - DNA, 22 bp, Magneporthe grisae
cccaagaacatgatggctgctt

SEQ ID NO: 754 - DNA, 29 bp, Magneporthe grisae
gaggccgagtccaacatgaacgatcttgt

SEQ ID NO: 755 - DNA, 26 bp, Magneporthe grisae
gagggtatggacgagatggagttcac

SEQ ID NO: 756 - DNA, 33 bp, Magneporthe grisae
gatctccgcaagcttgccgtcaacatggttccc

SEQ ID NO: 757 - DNA, 21 bp, Magneporthe grisae
gccgagtccaacatgaacgat

SEQ ID NO: 758 - DNA, 23 bp, Magneporthe grisae
gccgtcaacatggttcccttccc

SEQ ID NO: 759 - DNA, 23 bp, Magneporthe grisae
gctttcttgcattggtacactgg

SEQ ID NO: 760 - DNA, 26 bp, Magneporthe grisae
ggtatggacgagatggagttcactga

SEQ ID NO: 761 - DNA, 21 bp, Magneporthe grisae
gtcgagtggatccccaacaac

SEQ ID NO: 762 - DNA, 23 bp, Magneporthe grisae
tccgagtaccagcagtaccagga

SEQ ID NO: 763 - DNA, 26 bp, Magneporthe grisae
tccgagtaccagcagtaccaggatgc

SEQ ID NO: 764 - DNA, 22 bp, Magneporthe grisae
tgagcagttcactgccatgttc

SEQ ID NO: 765 - DNA, 32 bp, Magneporthe grisae
ttcttgcattggtacactggtgagggtatgga

SEQ ID NO: 766 - DNA, 23 bp, Magneporthe grisae
gaggctgagggctgtgactgcct

SEQ ID NO: 767 - DNA, 21 bp, Magneporthe grisae
gactgcctccagggtttccag

SEQ ID NO: 768 - DNA, 29 bp, Magneporthe grisae
gacgagaccttctgcattgacaacgaggc

SEQ ID NO: 769 - DNA, 29 bp, Magneporthe grisae
ggaaacaactgggccaagggtcactacac

SEQ ID NO: 770 - DNA, 23 bp, Magneporthe grisae
ttctgcattgacaacgaggctct

SEQ ID NO: 771 - DNA, 23 bp, Magneporthe grisae
tggtgctggaaacaactgggcca

SEQ ID NO: 772 - DNA, 26 bp, Magneporthe grisae
attcagtccgtcaaaggaaaggttgt

SEQ ID NO: 773 - DNA, 23 bp, Magneporthe grisae
ttgatgtttttgccatgccacaa

SEQ ID NO: 774 - DNA, 30 bp, Magneporthe grisae
ctcaagaacaagcgtgaggtctggcgtgtc

SEQ ID NO: 775 - DNA, 27 bp, Magneporthe grisae
ctcgccaagtccatccaccacgcccgt

SEQ ID NO: 776 - DNA, 24 bp, Magneporthe grisae
gactcccagaagcacatcgacttc

SEQ ID NO: 777 - DNA, 22 bp, Magneporthe grisae
gtctcaagaacaagcgtgaggt

SEQ ID NO: 778 - DNA, 21 bp, Magneporthe grisae
atcaaggtcaacgacactgtc

SEQ ID NO: 779 - DNA, 24 bp, Magneporthe grisae
gccgaggaggccgagtacaagctc

SEQ ID NO: 780 - DNA, 21 bp, Magneporthe grisae
ttcggagaaatggaacgtgat

SEQ ID NO: 781 - DNA, 26 bp, Magneporthe grisae
aacaaggatatccgtaagttcttgga

SEQ ID NO: 782 - DNA, 25 bp, Magneporthe grisae
tacgcccatttccccatcaacgtca

SEQ ID NO: 783 - DNA, 29 bp, Magneporthe grisae
caggtcttctggggtctcgacaagaaact

SEQ ID NO: 784 - DNA, 27 bp, Magneporthe grisae
acctacaagaacgtccccaactggcac

SEQ ID NO: 785 - DNA, 27 bp, Magneporthe grisae
gtgaaggccaagaccatcaccttccac

SEQ ID NO: 786 - DNA, 23 bp, Magneporthe grisae
tacaacttcgagaagcctttcct

SEQ ID NO: 787 - DNA, 21 bp, Magneporthe grisae
ttcgagaagcctttcctgtgg

SEQ ID NO: 788 - DNA, 29 bp, Magneporthe grisae
caggtcttctggggtctcgacaagaaact

SEQ ID NO: 789 - DNA, 22 bp, Magneporthe grisae
gccgagtacttccgtgaccagg

SEQ ID NO: 790 - DNA, 21 bp, Magneporthe grisae
tccaagggccgcaagttcgag

SEQ ID NO: 791 - DNA, 26 bp, Magneporthe grisae
aaggctttcttgcattggtacactgg

SEQ ID NO: 792 - DNA, 26 bp, Magneporthe grisae
accgccatccaggagctgttcaagcg

SEQ ID NO: 793 - DNA, 30 bp, Magneporthe grisae
atggacgagatggagttcactgaggccgag

SEQ ID NO: 794 - DNA, 35 bp, Magneporthe grisae
atgttcaggcgcaaggctttcttgcattggtacac

SEQ ID NO: 795 - DNA, 26 bp, Magneporthe grisae
gagggtatggacgagatggagttcac

SEQ ID NO: 796 - DNA, 23 bp, Magneporthe grisae
gccatccaggagctgttcaagcg

SEQ ID NO: 797 - DNA, 26 bp, Magneporthe grisae
gctttcttgcattggtacactggtga

SEQ ID NO: 798 - DNA, 21 bp, Magneporthe grisae
gtcgagtggatccccaacaac

SEQ ID NO: 799 - DNA, 26 bp, Magneporthe grisae
gtttccgagtaccagcagtaccagga

SEQ ID NO: 800 - DNA, 23 bp, Magneporthe grisae
tccgagtaccagcagtaccagga

SEQ ID NO: 801 - DNA, 23 bp, Magneporthe grisae
tggtacactggtgagggtatgga

SEQ ID NO: 802 - DNA, 26 bp, Magneporthe grisae
gctggaaacaactgggccaagggtca

SEQ ID NO: 803 - DNA, 26 bp, Magneporthe grisae
ctcgagcccggcaccatggacgccgt

SEQ ID NO: 804 - DNA, 21 bp, Magneporthe grisae
ctgcattgacaacgaggctct

SEQ ID NO: 805 - DNA, 34 bp, Magneporthe grisae
ctgcattgacaacgaggctctgtacgacatctgc

SEQ ID NO: 806 - DNA, 23 bp, Magneporthe grisae
gacaacttcgtcttcggtcagtc

SEQ ID NO: 807 - DNA, 23 bp, Magneporthe grisae
ggtgctggaaacaactgggccaa

SEQ ID NO: 808 - DNA, 22 bp, Magneporthe grisae
catgtctggcgtcaccacctgc

SEQ ID NO: 809 - DNA, 29 bp, Magneporthe grisae
aacaactgggccaagggtcactacactga

SEQ ID NO: 810 - DNA, 32 bp, Magneporthe grisae
gacgagaccttctgcattgacaacgaggctct

SEQ ID NO: 811 - DNA, 29 bp, Magneporthe grisae
ggaaacaactgggccaagggtcactacac

SEQ ID NO: 812 - DNA, 22 bp, Magneporthe grisae
atctccaagatccgcgaggagt

SEQ ID NO: 813 - DNA, 21 bp, Magneporthe grisae
cttccgccccgacaacttcgt

SEQ ID NO: 814 - DNA, 22 bp, Magneporthe grisae
tcttccgccccgacaacttcgt

SEQ ID NO: 815 - DNA, 23 bp, Magneporthe grisae
ccgacaacttcgtcttcggtcag

SEQ ID NO: 816 - DNA, 21 bp, Magneporthe grisae
gagggtgccgagcttgtcgac

SEQ ID NO: 817 - DNA, 23 bp, Magneporthe grisae
gacaacttcgtcttcggtcagtc

SEQ ID NO: 818 - DNA, 21 bp, Magneporthe grisae
ctcgagcccggcaccatggac

SEQ ID NO: 819 - DNA, 21 bp, Magneporthe grisae
ccccgacaacttcgtcttcgg

SEQ ID NO: 820 - DNA, 26 bp, Magneporthe grisae
ttccgccccgacaacttcgtcttcgg

SEQ ID NO: 821 - DNA, 25 bp, Magneporthe grisae
ggtctcatgttagccaaccacacca

SEQ ID NO: 822 - DNA, 21 bp, Magneporthe grisae
cggcagctgcgactgcggccg

SEQ ID NO: 823 - DNA, 23 bp, Magneporthe grisae
ctcttggtgaagctctaccgctt

SEQ ID NO: 824 - DNA, 23 bp, Magneporthe grisae
gttgtcggcaccgtcaccgacga

SEQ ID NO: 825 - DNA, 21 bp, Magneporthe grisae
catcccggtttcggctgctgg

SEQ ID NO: 826 - DNA, 21 bp, Magneporthe grisae
gtggatatcaacactcagcag

SEQ ID NO: 827 - DNA, 24 bp, Magneporthe grisae
aacaagcgtgaggtctggcgtgtc

SEQ ID NO: 828 - DNA, 23 bp, Magneporthe grisae
cgcatgaagctcgattacgttct

SEQ ID NO: 829 - DNA, 27 bp, Magneporthe grisae
ctcgactcccagaagcacatcgacttc

SEQ ID NO: 830 - DNA, 29 bp, Magneporthe grisae
gacgagtcgcgcatgaagctcgattacgt

SEQ ID NO: 831 - DNA, 30 bp, Magneporthe grisae
tggtctcgccaagtccatccaccacgcccg

SEQ ID NO: 832 - DNA, 23 bp, Magneporthe grisae
acttaccccgccggcttcatgga

SEQ ID NO: 833 - DNA, 26 bp, Magneporthe grisae
aacaaggatatccgtaagttcttgga

SEQ ID NO: 834 - DNA, 22 bp, Magneporthe grisae
ccaccctccgtaccgtccgcac

SEQ ID NO: 835 - DNA, 22 bp, Magneporthe grisae
gaacaaggatatccgtaagttc

SEQ ID NO: 836 - DNA, 24 bp, Magneporthe grisae
gatatccgtaagttcttggatggt

SEQ ID NO: 837 - DNA, 21 bp, Magneporthe grisae
tacgcccatttccccatcaac

SEQ ID NO: 838 - DNA, 26 bp, Magneporthe grisae
aaccagctgctgacggagatggacgg

SEQ ID NO: 839 - DNA, 27 bp, Magneporthe grisae
cagcgcaagcacttcccgtccatcaac

SEQ ID NO: 840 - DNA, 23 bp, Magneporthe grisae
ttctggggtctcgacaagaaact

SEQ ID NO: 841 - DNA, 21 bp, Magneporthe grisae
cggcaagtgcggttccgtcac

SEQ ID NO: 842 - DNA, 26 bp, Magneporthe grisae
aagaacctgcagtattacgacatctc

SEQ ID NO: 843 - DNA, 26 bp, Magneporthe grisae
cagtattacgacatctcggccaagtc

SEQ ID NO: 844 - DNA, 29 bp, Magneporthe grisae
tcacctacaagaacgtccccaactggcac

SEQ ID NO: 845 - DNA, 22 bp, Magneporthe grisae
caatttcgccatcgatatggcc

SEQ ID NO: 846 - DNA, 21 bp, Magneporthe grisae
gccgagtacttccgtgaccag

SEQ ID NO: 847 - DNA, 27 bp, Magneporthe grisae
cagcgcaagcacttcccgtccatcaac

SEQ ID NO: 848 - DNA, 23 bp, Magneporthe grisae
ttctggggtctcgacaagaaact

SEQ ID NO: 849 - DNA, 22 bp, Magneporthe grisae
aaggaagcagaggaagaagaaa

SEQ ID NO: 850 - DNA, 21 bp, Magneporthe grisae
gacggcaaggtccgcaccgac

SEQ ID NO: 851 - DNA, 21 bp, Magneporthe grisae
cgaggaggccgagtacaagct

SEQ ID NO: 852 - DNA, 32 bp, Magneporthe grisae
atctccctgcccaagggcaagggtgtcaagct

SEQ ID NO: 853 - DNA, 25 bp, Magneporthe grisae
tcaaggttgacggcaaggtccgcac

SEQ ID NO: 854 - DNA, 23 bp, Magneporthe grisae
acttaccccgccggcttcatgga

SEQ ID NO: 855 - DNA, 21 bp, Magneporthe grisae
cggttgggtcaagcacggatt

SEQ ID NO: 856 - DNA, 22 bp, Magneporthe grisae
cagggatgcctactccggtggt

SEQ ID NO: 857 - DNA, 23 bp, Magneporthe grisae
aagggccgcaagttcgagaaggc

SEQ ID NO: 858 - DNA, 23 bp, Magneporthe grisae
gttgtcggcaccgtcaccgacga

SEQ ID NO: 859 - DNA, 23 bp, Magneporthe grisae
ctcttggtgaagctctaccgctt

The invention claimed is:

1. A method for controlling fungal growth on a cell or an organism or for preventing fungal infestation of a cell or an organism susceptible to fungal infection, comprising contacting fungal cells with a composition comprising a double-stranded RNA from outside the fungal cell(s), wherein the double-stranded RNA comprises annealed complementary strands, one of which comprises a nucleotide sequence selected from the group consisting of:

(i) nucleotide sequences complementary to at least 21 contiguous nucleotides of the nucleotide sequence of a fungal target gene represented by SEQ ID NOs: 9 or 45, (ii) nucleotide sequences complementary to at least 21 contiguous nucleotides of a nucleotide sequence encoding the amino acid sequence represented by SEQ ID NO: 10, and (iii) nucleotide sequences at least 85% identical to the nucleotide sequences of (i), whereby the double-stranded RNA is taken up into the fungal cells and whereby the inhibition of said fungal target gene decreases or stops fungal infestation.

2. A method for down-regulating expression of a target gene in a fungus, comprising contacting fungal cell(s) with a composition comprising a double-stranded RNA outside the fungal cell(s), wherein the double-stranded RNA comprises annealed complementary strands, one of which comprises a nucleotide sequence selected from the group consisting of:

(i) nucleotide sequences complementary to at least 21 contiguous nucleotides of the nucleotide sequence of a fungal target gene represented by SEQ ID NOs: 9 or 45, (ii) nucleotide sequences complementary to at least 21 contiguous nucleotides of a nucleotide sequence encoding the amino acid sequence represented by SEQ ID NO: 10, and (iii) nucleotide sequences at least 85% identical to the nucleotide sequences of (i), whereby the double-stranded RNA is taken up into the fungal cells and whereby the inhibition of said fungal target gene decreases or stops fungal infestation.

3. A method according to claim 1 or 2, wherein said double-stranded RNA is expressed by a prokaryotic or eukaryotic host cell or host organism.

4. A method according to claim 1 wherein said double-stranded RNA is expressed by said cell or organism infested with or susceptible to infestation by said fungus.

5. A method according to claim 4 wherein said cell is a plant cell or wherein said organism is a plant.

6. A method according to claim 1 or 2, wherein said double-stranded RNA is expressed from a recombinant construct, which construct comprises at least one regulatory sequence operably linked to a nucleotide sequence encoding said double-stranded RNA.

7. A method for producing a plant resistant against a plant pathogenic fungus, comprising:

(a) transforming a plant cell with a recombinant construct comprising at least one regulatory sequence operably linked to a nucleotide sequence encoding a double-stranded RNA, wherein the double-stranded RNA comprises annealed complementary strands, one of which comprises a nucleotide sequence selected from the group consisting of:

(i) nucleotide sequences complementary to at least 21 contiguous nucleotides of the nucleotide sequence of a fungal target gene represented by SEQ ID NOs: 9 or 45, (ii) nucleotide sequences complementary to at least 21 contiguous nucleotides of a nucleotide sequence encoding the amino acid sequence represented by SEQ ID NO: 10, and (iii) nucleotide sequences at least 85% identical to the nucleotide sequences of (i), (b) regenerating a plant from the transformed plant cell; and (c) growing the transformed plant under conditions suitable for the expression of the recombinant construct, said grown transformed plant resistant to fungi compared to an untransformed plant, thereby producing a fungus-resistant plant.

8. A method according to claim 7 wherein said plant is chosen from the group consisting of rice, corn, soybean, cotton, potato, banana, tomato, wheat, sorghum, millet, beans, groundnuts, rapeseed, sunflower and sugarcane; preferably chosen from rice, corn, soybean, cotton, potato, banana and tomato.

9. A method according to claim 8 wherein said plant is rice and wherein said target gene is a gene from a fungus selected from the group consisting of *Magnaporthe* spp., *Rhizoctonia* spp., *Acremoniella* spp., *Phytium* spp., *Curvularia* spp., *Trichoderma* spp., *Fusarium* spp. and *Rhizopus* spp.

10. A method according to claim 8 wherein said plant is corn and wherein said target gene is a gene from a fungus selected from the group consisting of *Colletotrichum* spp., *Gibberella* spp., *Fusarium* spp., *Diplodia* spp. and *Puccina* spp.

11. A method according to claim 8 wherein said plant is soybean and wherein said target gene is a gene from *Phakopsora* spp.

12. A method according to claim 8 wherein said plant is cotton and wherein said target gene is a gene from a fungus selected from the group consisting of *Fusarium* spp. and *Verticillium* spp.

13. A method according to claim 8 wherein said plant is potato and wherein said target gene is a gene from a fungus selected from the group consisting of *Phytophthora* spp., *Rhizoctonia* spp. and fungal species that cause wilt, rot or scurf.

14. A method according to claim 8 wherein said plant is banana and wherein said target gene is a gene from a fungus selected from the group consisting of *Mycosphaerella* spp., *Cercospora* spp. and *Fusarium* spp.

15. A method according to claim 8 wherein said plant is tomato and wherein said target gene is a gene from a fungus selected from the group consisting of *Phytophthora* spp. and fungal species that cause foliar disease, wilt or fruit rot.

16. A method for treating and/or preventing fungal growth and/or fungal infestation of a plant or propagative or reproductive material of a plant comprising applying to a plant or to propagation or reproductive material of a plant an effective amount of a composition comprising a double-stranded RNA, wherein the double-stranded RNA comprises annealed complementary strands, one of which comprises a nucleotide sequence selected from the group consisting of:

(i) nucleotide sequences complementary to at least 21 contiguous nucleotides of the nucleotide sequence of a fungal target gene represented by SEQ ID NOs: 9 or 45, (ii) nucleotide sequences complementary to at least 21 contiguous nucleotides of a nucleotide sequence encoding the amino acid sequence represented by SEQ ID NO: 10, and (iii) nucleotide sequences at least 85% identical to the nucleotide sequences of (i) whereby upon fungal infestation the double-stranded RNA is taken up into the fungal cells and whereby the inhibition of said fungal target gene decreases or stops fungal infestation.

* * * * *